US012656335B2

(12) United States Patent
Benkirane et al.

(10) Patent No.: US 12,656,335 B2
(45) Date of Patent: Jun. 16, 2026

(54) ANTI-CD32A ANTIBODIES AND THEIR USE FOR EVALUATING THE PRESENCE OF A VIRAL RESERVOIR

(71) Applicants: CENTRE NATIONAL DE LA RECHERCHE SCIENTIFIQUE, Paris (FR); UNIVERSITÉ DE MONTPELLIER, Montpellier (FR)

(72) Inventors: Monsef Benkirane, Saint Gely du Fesc (FR); Gaël Petitjean, Montpellier (FR); Benjamin Descours, Montpellier (FR)

(73) Assignees: CENTRE NATIONAL DE LA RECHERCHE SCIENTIFIQUE, Paris (FR); UNIVERSITÉ DE MONTPELLIER, Montpellier (FR)

( * ) Notice: Subject to any disclaimer, the term of this patent is extended or adjusted under 35 U.S.C. 154(b) by 1338 days.

(21) Appl. No.: 17/405,419

(22) Filed: Aug. 18, 2021

(65) Prior Publication Data

US 2021/0405026 A1 Dec. 30, 2021

Related U.S. Application Data

(63) Continuation-in-part of application No. 16/336,988, filed as application No. PCT/IB2017/056054 on Sep. 30, 2017, now Pat. No. 11,125,751.

(30) Foreign Application Priority Data

Sep. 30, 2016 (FR) ..................................... 16/59440
Mar. 15, 2017 (FR) ..................................... 17/52126

(51) Int. Cl.
*G01N 33/50* (2006.01)
*C07K 16/28* (2006.01)

(52) U.S. Cl.
CPC ....... *G01N 33/5014* (2013.01); *C07K 16/283* (2013.01); *G01N 33/505* (2013.01); *C07K 2317/24* (2013.01); *G01N 2333/70535* (2013.01)

(58) Field of Classification Search
None
See application file for complete search history.

(56) References Cited

U.S. PATENT DOCUMENTS

2017/0350889 A1 12/2017 Benkirane

FOREIGN PATENT DOCUMENTS

| | | | |
|---|---|---|---|
| JP | 2016-527314 | A | 9/2016 |
| WO | 2015/021089 | A1 | 2/2015 |
| WO | 2015/149077 | A1 | 10/2015 |
| WO | 2016/014484 | A1 | 1/2016 |
| WO | 2016/102829 | A1 | 6/2016 |
| WO | 2016110576 | A1 | 7/2016 |

OTHER PUBLICATIONS

Veri et al., "Therapeutic Control of B Cell Activation via Recruitment of Fcγ Receptor IIb (CD32B) Inhibitory Function With a Novel Bispecific Antibody Scaffold," Arthritis & Rheumatism, vol. 62, No. 7, Jul. 2010, 11 pages (pp. 1933-1943,) XP-002605114.

International Search Report including English translation and Written Opinion dated Mar. 13, 2018 of corresponding application No. PCT/IB2017/056054; 24 pages.

Gael Petitjean et al. "Isolation and characterization of HIV-1-infected resting CD4<+> T lymphocytes in breast milk", Journal of Clinical Virology, Elsevier, Amsterdam, NL, vol. 39, No. 1,Apr. 17, 2007, pp. 1-8, 8 pgs.

Gregory M. Laird et al., "Rapid Quantification of the Latent Reservoir for HIV-1 Using a Viral Outgrowth Assay", PLOS Pathogens, vol. 9, No. 5, May 30, 2013, 11 pgs.

Benjamin Descours et al., "CD32a is a marker of a CD4 T-cell HIV reservoir harbouring replication-competent proviruses", Nature, vol. 543, No. 7646, Mar. 15, 2017, pp. 564-567, 8 pgs.

Chun et al., "Presence of an inducible HIV-1 latent reservoir during highly active antiretroviral therapy", Proc Natl Acad Sci USA, vol. 94, Nov. 1997, pp. 13193-13197, 5 pgs.

Finzi et al., "Identification of a Reservoir for HIV-1 in Patients on Highly Active Antiretroviral Therapy" Science vol. 278, Nov. 14, 1997, pp. 1295-1300, 6 pgs.

Chomont et al., "HIV reservoir size and persistence are driven by T cell survival and homeostatic proliferation", 2009 Nature Medicine vol. 15, No. 8, pp. 893-900, 9 pgs.

Buzon et al., Nature Medicin, 2014, 20(2):139-144. (Year: 2014).

Guyader et al., Nature, 1987, 326:662-669. (Year: 1987).

Murray et al., Journal of Immunology, Jul. 2016, 197:407-417. (Year: 2016).

Olmsted et al., Proc. Natl. Acad. Sci. USA, 1989, 86:8088-8092. (Year: 1989).

Horejs-Hoeck et al., Immunology, 2005, 115, 407-415. (Year: 2005).

*Primary Examiner* — Nicole Kinsey White
(74) *Attorney, Agent, or Firm* — Maier & Maier, PLLC

(57) ABSTRACT

Monospecific anti-CD32a and bispecific anti-CD32a/CD3 antibodies and their use for evaluating the presence of a viral reservoir by quantifying the presence of lymphocyte cells expressions a CD32 and/or CD3 differentiation marker on their cell surface. Also, a method for the evaluation of the efficacy of a drug aiming to eradicate a cellular reservoir of mammalian cells infected with a mammalian immunodeficiency virus.

4 Claims, 12 Drawing Sheets

Specification includes a Sequence Listing.

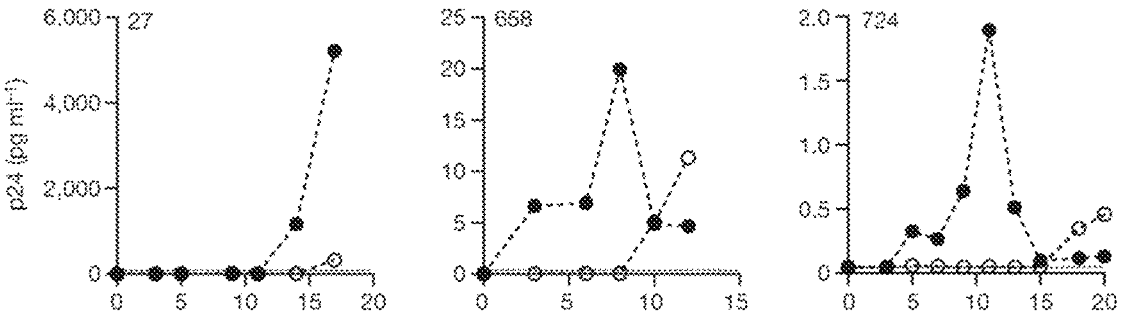
Fig. 18
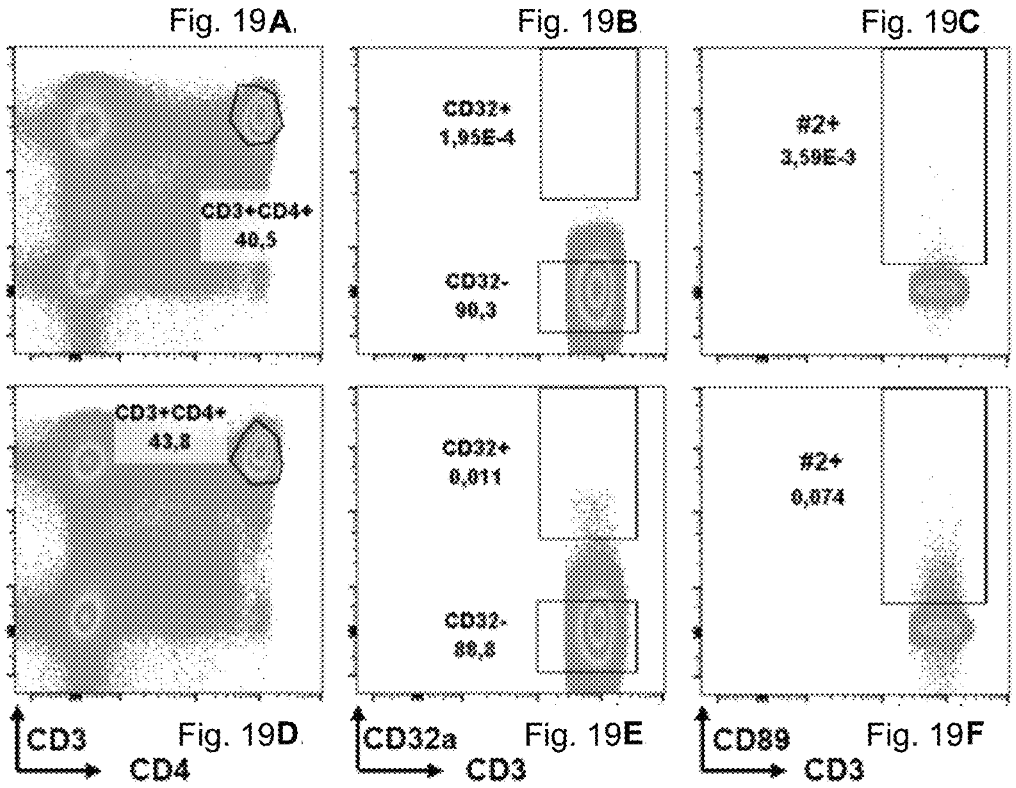

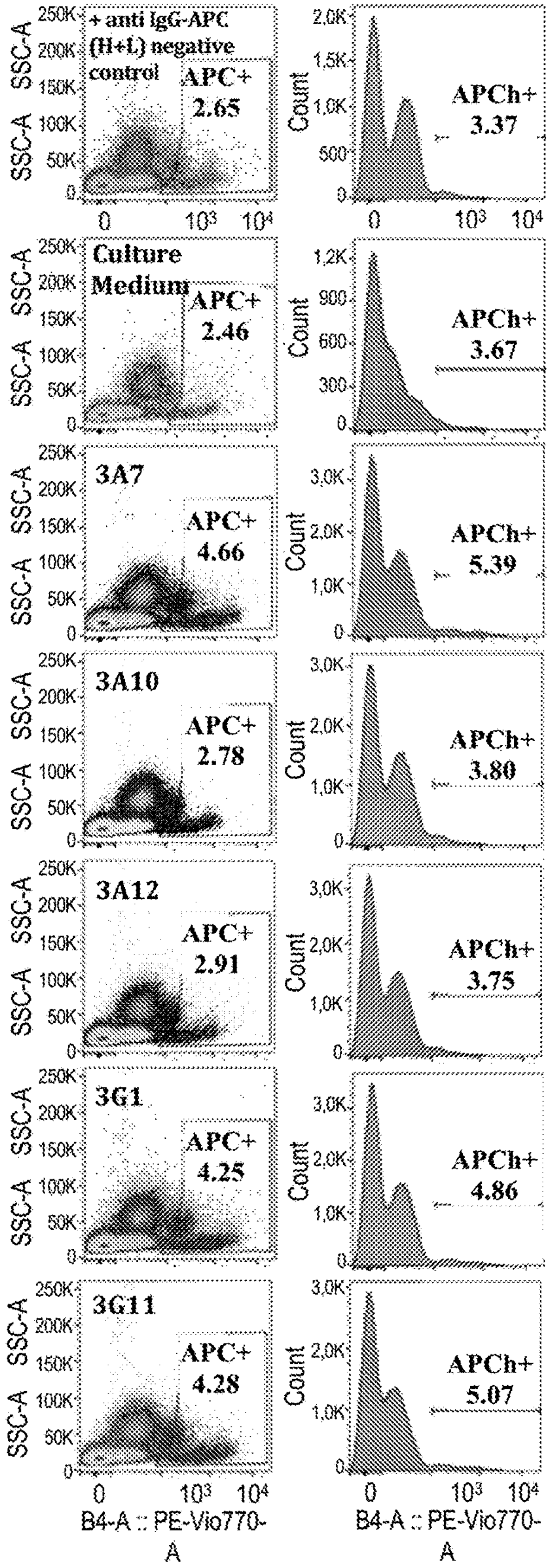
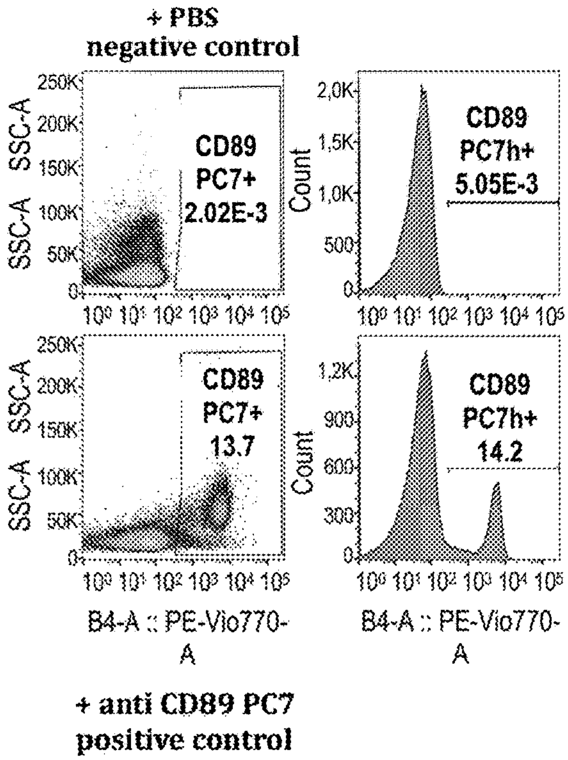
| Hybridoma | Absorbance coating protein rhFCAR | | Absorbance coating anti mouse Ig | |
|---|---|---|---|---|
| | pur | 1/10th | pur | 1/10th |
| 2H12-3H5-3A7 | 0,058 | 0,044 | 2,383 | 2,429 |
| 2H12-3H5-3A10 | 0,051 | 0,043 | 0,335 | 0,216 |
| 2H12-3H5-3A12 | 0,048 | 0,051 | 0,802 | 0,296 |
| 2H12-3H5-3G1 | 0,055 | 0,044 | 2,340 | 2,350 |
| 2H12-3H5-3G11 | 0,058 | 0,058 | 2,365 | 2,517 |
| | | | | |
| Background | 0,047 | | 0,047 | |
| Positive control | 2,649 | | 2,630 | |
Fig. 24

ANTI-CD32A ANTIBODIES AND THEIR USE FOR EVALUATING THE PRESENCE OF A VIRAL RESERVOIR

CROSS-REFERENCE TO RELATED APPLICATIONS

This application is a continuation in part of U.S. patent application Ser. No. 16/336,988, filed Mar. 27, 2019, which is a national phase application of International Patent Application No. PCT/IB2017/056054, filed Sep. 30, 2017, which claims priority to French Patent Application No. 1659440, filed Sep. 30, 2016 and French Patent Application No. 1752126, filed Mar. 15, 2017, the entire contents of which are incorporated herein by reference.

FIELD

The invention relates to membrane markers and the use thereof as part of identifying infected cells forming the viral reservoir, in particular cells infected with retroviruses.

BACKGROUND

Anti-retroviral treatments significantly improve the prognosis of patients infected with human immunodeficiency virus (HIV) and in particular alter the capacity of the virus to multiply.

These treatments are not sufficiently effective such that they can be stopped, however, since they do not eliminate the cellular reservoirs of the virus, and treatment being interrupted virtually systematically results in the virus reappearing in the blood, evidence that the infection persists.

The persistence of these latent viral reservoirs is therefore a major obstacle to the concept of curing the HIV infection and has become a major issue in clinical and scientific fields.

Recent work has shown that quiescent TCD4 lymphocytes, once patients are infected, constitute the main viral reservoirs, which are capable of persisting for many years on treatment [Chun et al., 1997. Proc Natl Acad Sci USA 94, 13193-13197; Finzi et al., 1997 Science 278, 1295-1300; Chomont et al., 2009 Nat Med 15, 893-900.].

However, no marker that makes it possible to differentiate the HIV cellular reservoirs from the non-infected cells has been identified thus far.

In the absence of markers that make it possible to identify these viral reservoirs, different strategies which aim to target the persistence thereof by "purging" the virus that they host have been tested; however, these strategies have not allowed the efficacy thereof observed in the laboratory to be reproduced in patients. It is possible that the in vitro conditions in which these strategies have been tested are too far removed from the "patient context".

In addition, there is a need to identify these cells in order to eradicate the viral infection completely.

The invention is proposing measures to overcome these shortcomings in the prior art.

SUMMARY

One of the objects of the invention is to propose the use of new markers that make it possible to identify the cellular reservoirs.

Another object of the invention is to provide methods for identifying and eradicating the cellular reservoirs of the virus.

The invention relates to the use of a cell marker, expressed on the surface of the lymphoid cells, and potentially myeloid cells, for the detection of cellular reservoirs of at least one lentivirus, in particular a lentivirus, said cellular reservoirs being cells infected with said lentivirus and being unresponsive to the specific therapeutic agents for said lentivirus. The invention further relates to the use of a means for detecting a cell marker, expressed on the surface of the lymphoid cells, and potentially myeloid cells, for the detection of cellular reservoirs of at least one lentivirus, in particular a lentivirus, said cellular reservoirs being cells infected with said lentivirus and being unresponsive to the specific therapeutic agents of said lentivirus.

The invention is based on the surprising observation made by the inventors that the cell markers, and in particular certain markers of clusters of differentiation (CD), are specifically expressed, or expressed at a certain level relative to the level of expression of said markers in a non-infected cell by a lentivirus, by the cellular reservoirs of at least one lentivirus.

Lastly, the remaining cells are infected with an HIV virus allowing the constitutive expression of the GFP (C.). The cell fraction exposed to HIV is thus divided into two categories: the exposed, non-infected cells that do not express the GFP (2.) and the cells exposed to the virus that are infected and express the GFP (1.).

The different cells are sorted by means of a flow cytometer in preparation for the extraction of their RNA, the sequencing of said extracted RNA, bioinformatic analyses, and the validation of the candidates by means of flow cytometry.

Figure 2:
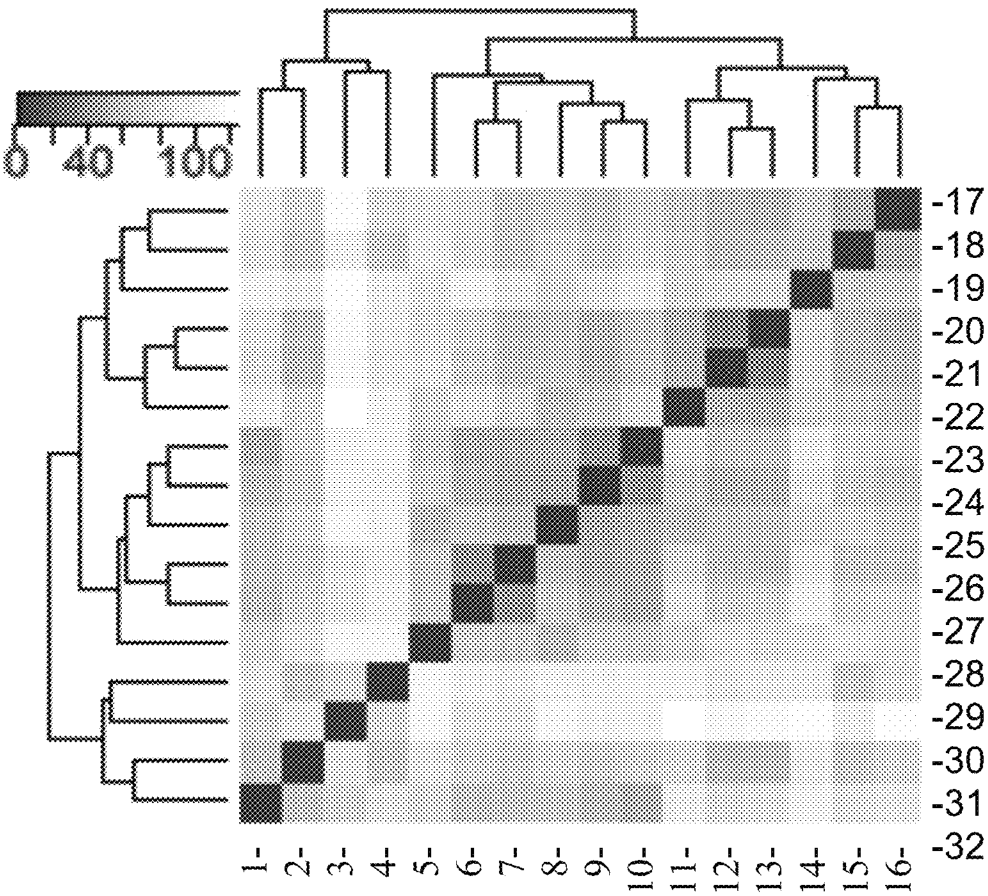

FIG. 2 is a colored chart (which is in black and white here) showing the hierarchical clustering that is carried out over the Euclidean distance and is calculated using regularized-log transformed gene expression counts, between each sub-assembly of cells 1. to 3, and non-infected cells (4.). The chart shows the results for PBMCs originating from four different donors.

1—: cells 1. originating from individual 2; 2—: cells 1. originating from individual 4; 3—: cells 1. originating from individual 1; 4—: cells 1. originating from individual 3; 5—: cells 4. originating from individual 4; 6—: cells 3. originating from individual 1; 7—: cells 2. originating from individual 1; 8—: cells 4. originating from individual 1; 9—: cells 3. originating from individual 2; 10—: cells 2. originating from individual 2; 11—: cells 4. originating from individual 3; 12—: cells 3. originating from individual 4; 13—: cells 2. originating from individual 4; 14—: cells 4. originating from individual 2; 15—: cells 3. originating from individual 3; 16—: cells 2. originating from individual 3; 17—: cells 2. originating from individual 3; 18—: cells 3. originating from individual 3; 19—: cells 4. originating from individual 2; 20—: cells 2. originating from individual 4; 21—: cells 3. originating from individual 4; 22—: cells 4. originating from individual 3; 23—: cells 2. originating from individual 2; 24—: cells 3. originating from individual 2; 25—: cells 4. originating from individual 1; 26—: cells 2. originating from individual 1; 27—: cells 3. originating from individual 1; 28—: cells 4. originating from individual 4; 29—: cells 1. originating from individual 3; 30—: cells 1. originating from individual 1; 31—: cells 1. originating from individual 4 and 32—: cells 1. originating from individual 2.

Figure 3:
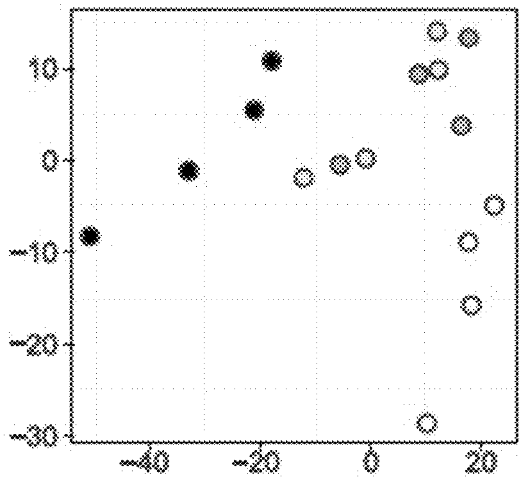

FIG. 3 is a graph showing the principal component analysis of the regularized-log transformed gene expression counts for the sub-groups 1. (black points), 2. (dark gray points), 3. (light gray points) and 4. (white points) from 4 healthy donors. This graph shows points for two first principal components. The x axis shows PC2: 17% of the variance and the y axis shows PC1: 58% of the variance.

Figure 4:
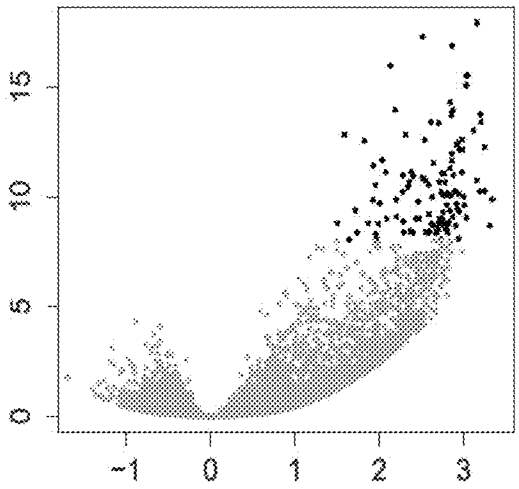

FIG. 4 shows a volcano plot showing the significance (false discovery rate (FDR)) and the gene expression modification between the infected TCD4 cells (1.) and the exposed, non-infected TCD4 cells (2.). The black points indicate the genes selected owing to their significant over-expression in the fraction 1. compared with the cells 2. (FDR <10-8). The x axis shows the base-2 logarithm of the expression modification and the y axis shows the base-10 logarithm of FDR.

Figure 5:
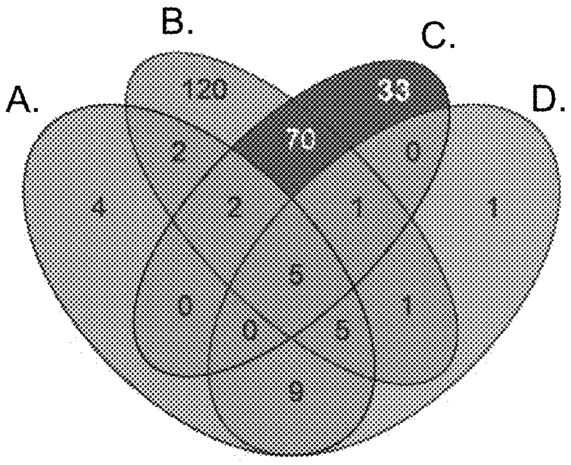

FIG. 5 shows a Venn diagram showing the 253 genes expressed in a differential manner between the 4 groups, in particular 2. vs. 1. (FDR <10-8). The dark gray intersections indicate genes selected for subsequent analysis. A: 4. vs. 3.; B: 4. vs. 1.; C: 2. vs. 1, and D: 4. vs. 2.

Figure 6:
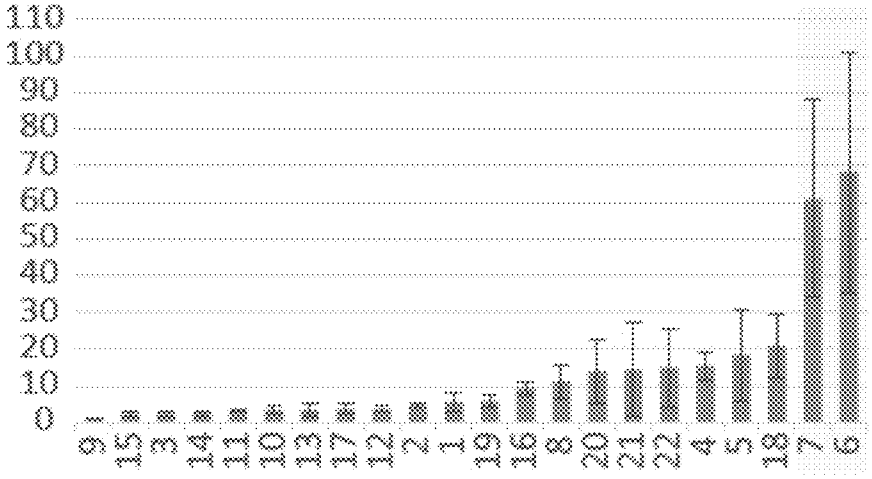

FIG. 6 shows a bar graph showing the results of expression augmentation cytometry (x axis) for each of the markers evaluated (genes 1 to 22 in the 111 potential candidates) in the TCD4 cells 1, and 2.

The markers are as follows: 9: aqp9, 15: mucl1, 3: ca12, 14: vnn3, 11: eaat1, 10: c22orf42, 13: gpr91, 17: cd66d, 12: step1b, 2: gjb2, 1: colec12, 19: cd80, 16: niacr1, 8: cd354, 20: cd116, 21: scarf1, 22: Ilrk2, 4: cd300c, 5: clec4d, 18: tlr2, 7: cd32 and 6: fprl1.

Figure 7:
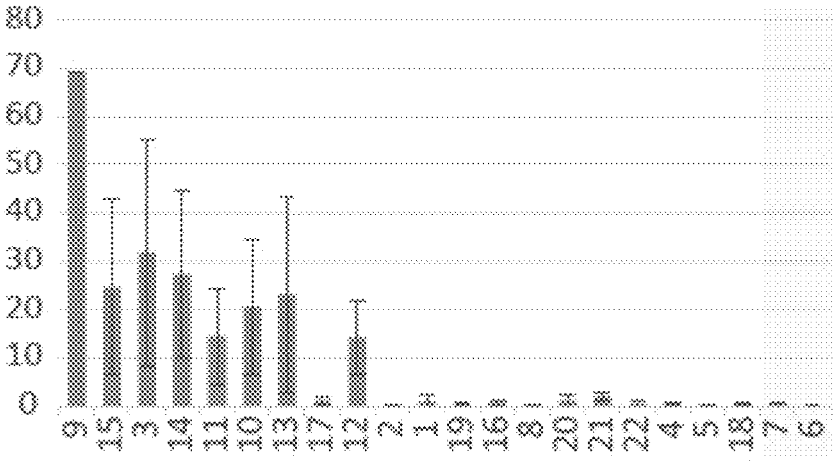

FIG. 7 shows a bar graph showing the percentage of total TCD4 cells 2. expressing each marker in order to highlight the expression of the most reliable candidates in the cells 1. The markers are as follows: 9: aqp9, 15: mucl1, 3: ca12, 14: vnn3, 11: eaat1, 10: c22orf42, 13: gpr91, 17: cd66d, 12: step1b, 2: gjb2, 1: colec12, 19: cd80, 16: niacr1, 8: cd354, 20: cd116, 21: scarf1, 22: Ilrk2, 4: cd300c, 5: clec4d, 18: tlr2, 7: cd32 and 6: fprl1.

Figure 8:
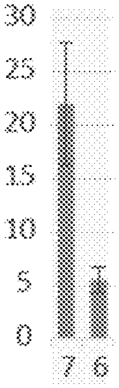

FIG. 8 shows a bar graph showing the percentage of total TCD4 cells 1. expressing the #7 marker (CD32) and the #6 marker (fprl1).

Figure 9A:
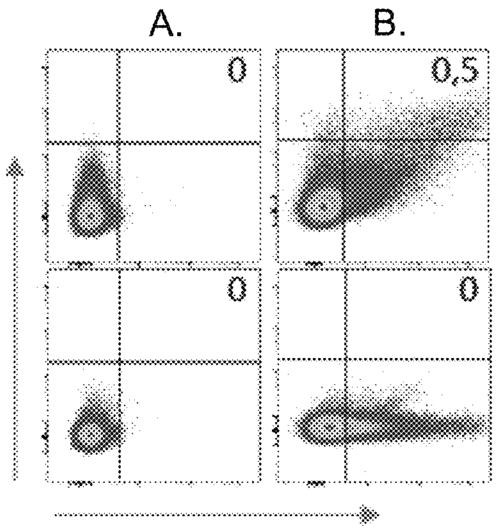
Figure 9B:
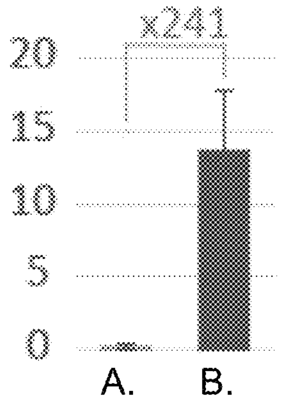

FIGS. 9A and 9B show the expression profiles of the #7 marker (CD32) in the viral latency model developed by the inventors.

Figure 1:
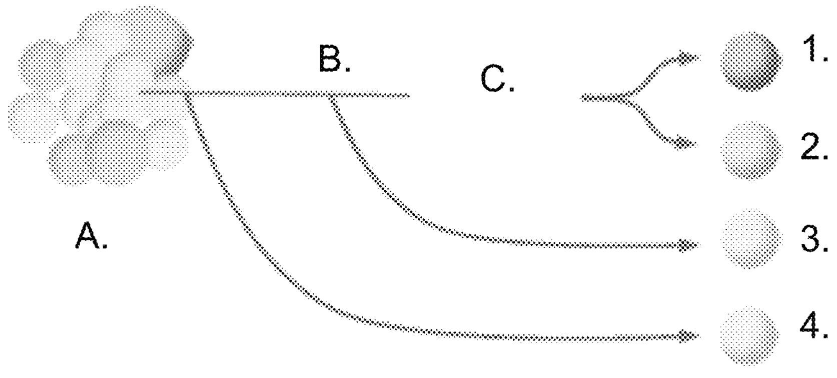
FIG. 1 shows the experimental approach used by the inventors to obtain TCD4 lymphocytes infected in a latent manner. A.: Peripheral blood mononuclear cells (PBMC) from healthy individuals (not infected with HIV) are taken at to. Without any further treatment, they constitute the control cells 4 (not infected; NI). The remainder of the PBMCs are treated with the protein Vpx (VLP-Vpx; B.). The cells that are not subsequently treated constitute the second control 3. of Vpx-treated, non-infected cells.

FIG. 9A shows the cytometry results for the TCD4 cells infected in a latent manner, generated as shown in FIG. 1. The expression of the #7 marker (CD32) was evaluated by flow cytometry on the surface of the infected TCD4 cells (1.; B.) and of the quiescent, non-infected TCD4 cells 2. (A.) (n=3). The GFP+/marker #7+ (CD32+) percentages are indicated in each panel. The x axis shows the fluorescence intensity of the GFP, and the y axis shows the fluorescence intensity of the CD32 marker.

FIG. 9B shows a bar graph indicating the percentage of cells expressing the #7+ (CD32+) marker between the cells 2. (GFPneg; A.) and 4. (GFPpos; B.).

Figure 10A:
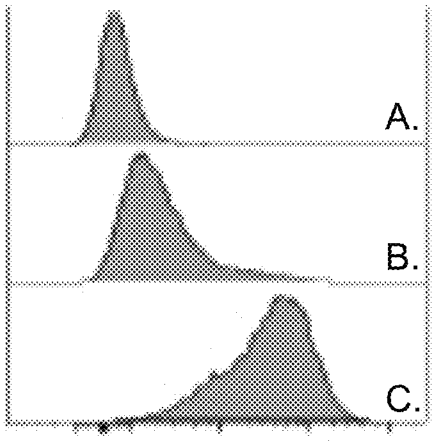
Figure 10B:
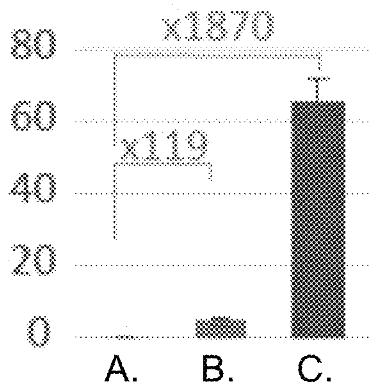

FIGS. 10A and 10B show the fluorescence intensity of the #7 (CD32) marker, correlated with the intensity of the expression of the GFP in the infected TCD4 cells (n=3).

FIG. 10A shows representations of the number of cells as a function of the fluorescence intensity of the CD32 marker for three sub-groups of cells: A.: the cells not expressing the GFP, B.: the cells weakly expressing the GFP, and C.: the cells strongly expressing the GFP.

FIG. 10B shows a graph of the percentage of CD32 marker in the TCD4 cells for the three categories, A., B., and C., described in FIG. 10A.

Figure 11A:
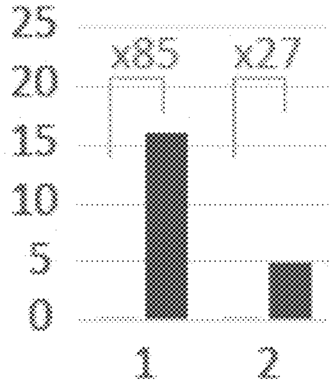
Figure 11B:
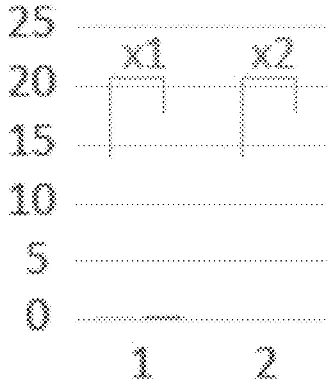

FIGS. 11A and 11B show graphs showing the expression of the #7 (CD32) marker on the surface of populations of non-stimulated TCD4 cells (11A) or TCD4 cells stimulated by the TCR path (n=2) (11B). The black bars show the percentage of positive GFP cells and the grey bars show the percentage of negative GFP cells.

Figure 12:
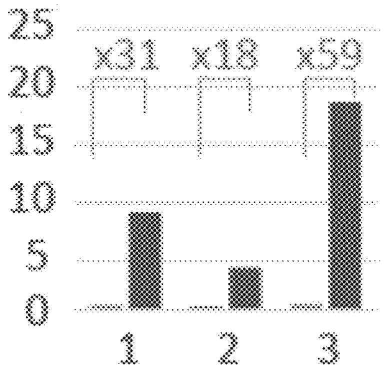

FIG. 12 shows a graph showing that the use of pseudotyped virus particles VSV-G makes it possible to evidence an induction of the expression of the #7 (CD32) marker on cells such as TCD8 cells (n=2). The average and the IQRs are present on each bar graph, along with the increase between the cells 2. (GFPneg) and 4. (GFP+) where necessary.

Figure 13A:
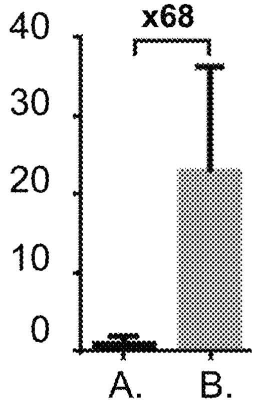
Figure 13B:
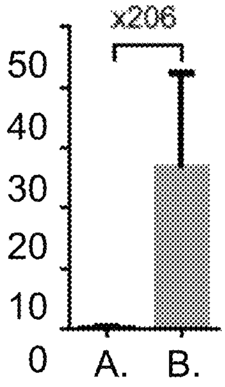

FIGS. 13A and 13B show the cytometry analysis of the induction of the #7 (CD32) marker on the surface of the quiescent infected TCD4 cells (GFP+) in comparison with cells that are not infected or are treated with only VLP-Vpx.

PBMCs from healthy donors (n=3) were infected with the SIVmac239 viruses (13A) and HIV-2 (13B). The results of the FACS analyses are represented in % of cells expressing the #7 (CD32) marker in the non-infected populations (GFP−; A.) and infected (GFP+; B.). The bar graphs show the average and the standard deviation for the experiments carried out using SIVmac239 and HIV-2.

Figure 14A:
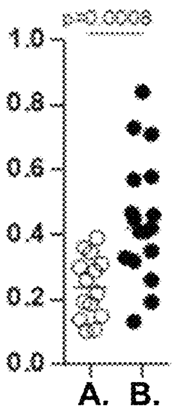
Figure 14B:
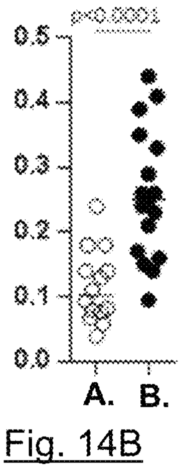

FIGS. 14A and 14B show bar graphs showing the comparison of the ex vivo level of expression of the #7 (CD32) marker on the surface of the TCD4 cells of patients who are infected with HIV-1 and virally suppressed (B) in comparison with healthy donors (A).

FIG. 14A shows the percentage of CD32+ cells in the total number of TCD4 cells.

FIG. 14A shows the percentage of CD32+ cells in the total number of immature DR+ TCD4 cells.

Figure 15A:
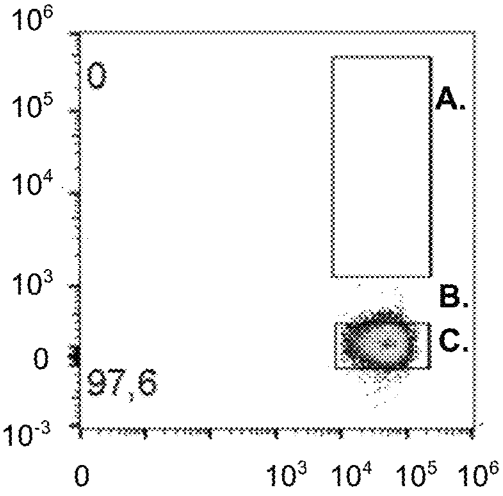
Figure 15B:
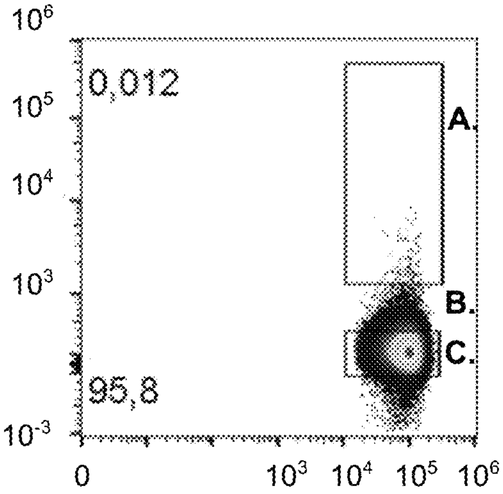
Figure 15C:
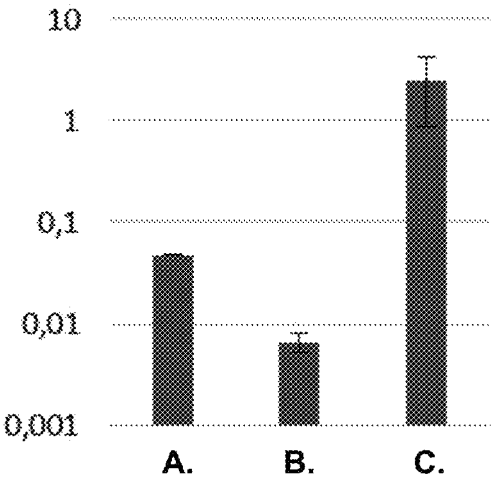

FIG. 15A to 15C show the results of expression of the CD32 marker in a first patient.

FIG. 15A shows the flow-cytometry results showing the different ex vivo levels of expression of the #7 (CD32) marker on the TCD4 lymphocytes (CD3+/CD4+ selection) in an aviremic patient (n=2), by means of an isotype. The x axis shows the level of fluorescence of CD3, and the y axis shows the level of fluorescence of CD32.

FIG. 15B shows the flow-cytometry results showing the different ex vivo levels of expression of the #7 (CD32) marker on the TCD4 lymphocytes (CD3+/CD4+ selection) in an aviremic patient (n=2), by means of an anti-CD32 antibody. A: cells strongly expressing CD32, B: cells weakly expressing CD32, and C: cells not expressing CD32. The x axis shows the fluorescence intensity of the CD3 marker, and the y axis shows the fluorescence intensity of the CD32 marker.

FIG. 15C shows a bar graph showing the number of copies of total HIV-1 DNA by cell quantified by qPCR (standardization with the beta-globin gene) on the cells: A: CD4+ cells; B: CD4+ CD32− cells, C: CD4+ CD32 strongly expressed.

Figure 16:
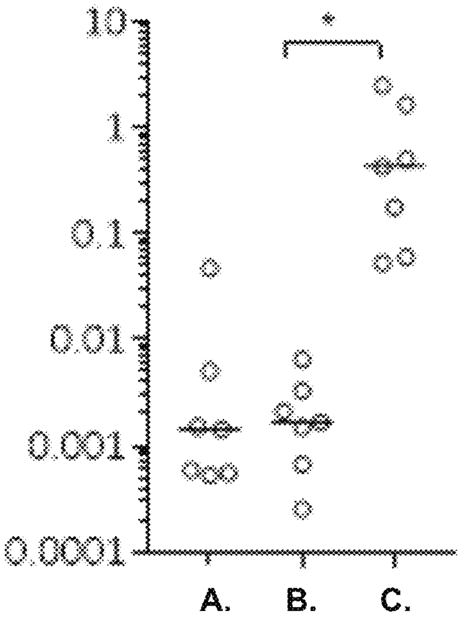

FIG. 16 is a graph showing the number of copies of HIV-1 DNA by cell, quantified by qPCR, in 7 aviremic patients in the populations of total TCD4 cells (A), the TCD4 CD32-(B) populations and TCD4 CD32+ (C) populations. A Wilcoxon test between the TCD4+ CD32− and CD32+ fractions shows significant enrichment in HIV-1 DNA in the CD32+ fraction ($p=0.0156$).

Figure 17:
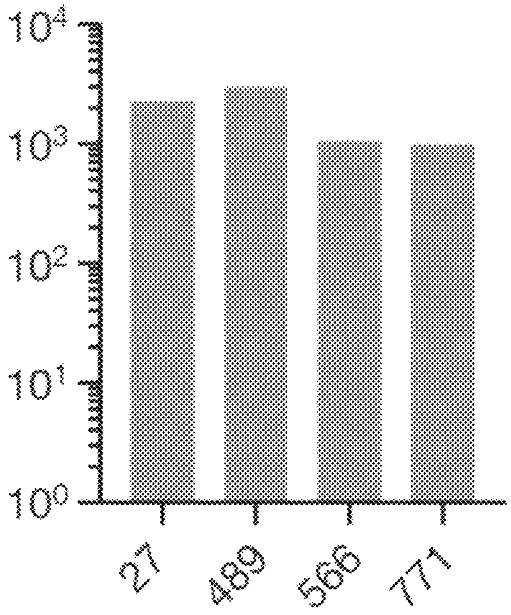

FIG. 17 is a bar graph showing the logarithm of the infectious units per million of the populations of TCD4 CD32+ cells originating from 4 patients (27, 439, 566 and 771) after reactivation of the HIV virus.

FIG. 18 shows three curves showing the viral reactivation over time (expressed in days, x axis) from populations of total TCD4 cells (black points) or TCD4 depleted in CD32 cells (grey points) from three samples from different, separate patients. The y axis shows the quantity of p24 in $pg \cdot ml^{-1}$.

FIG. 19A to 19C show flow-cytometry results showing the isotype controls (negative controls) of the CD32 and CD89 surface markers.

FIG. 19A shows flow-cytometry results on cells from patients and detected with the CD3 and CD4 markers. The CD4+CD3+ population is marked by a window (40.5% of the population).

FIG. 19B shows flow-cytometry results on cells from the window in FIG. 19A, and the isotype control markers for the CD32 marker, detected using CD3 and control isotype markers. The CD3 and isotype marked cells are detected for their positivity or negativity towards the CD32 antigen.

FIG. 19C shows flow-cytometry results on cells from the bottom window (CD32−) in FIG. 19B. The CD3 and isotype marked cells are detected for their positivity or negativity towards the CD89 antigen.

FIG. 19D to 19F show flow-cytometry results showing the CD32 and CD89 surface markers.

FIG. 19D shows flow-cytometry results on cells from patients and detected with the CD3 and CD4 markers. The CD4+CD3+ population is marked by a window (43.8% of the population).

FIG. 19E shows flow-cytometry results on cells from the window in FIG. 19A, and detected using CD3 and CD32 markers. The CD32+ cells (top window) and CD32− cells (bottom window; 88.8%) are indicated.

FIG. 19F shows flow-cytometry results on cells from the bottom window (CD32−) in FIG. 19B. The CD3 and CD89 marked cells are detected for their positivity or negativity towards the CD89 antigen. The window shows the CD89+ CD32− cells (0.074%).

Figure 20:
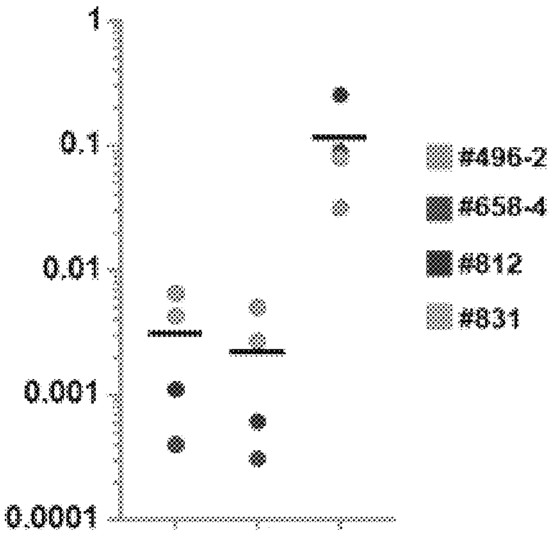

FIG. 20 is a graph showing the number of HIV DNA copies per cell from total populations of TCD4 cells (A), sub-populations of TCD4+CD32−CD89− cells (B), and sub-populations of TCD4+CD32−CD89+ cells (C) from 4 separate patients. The viral DNA present in each of these fractions was quantified by qPCR DNA HIV-1. In the patients tested, the CD89 marker indeed identifies a reservoir of infected cells (approximate median of 0.1 HIV-1 DNA copies per TCD4+ CD32a− CD89+ cell).

Figure 21:
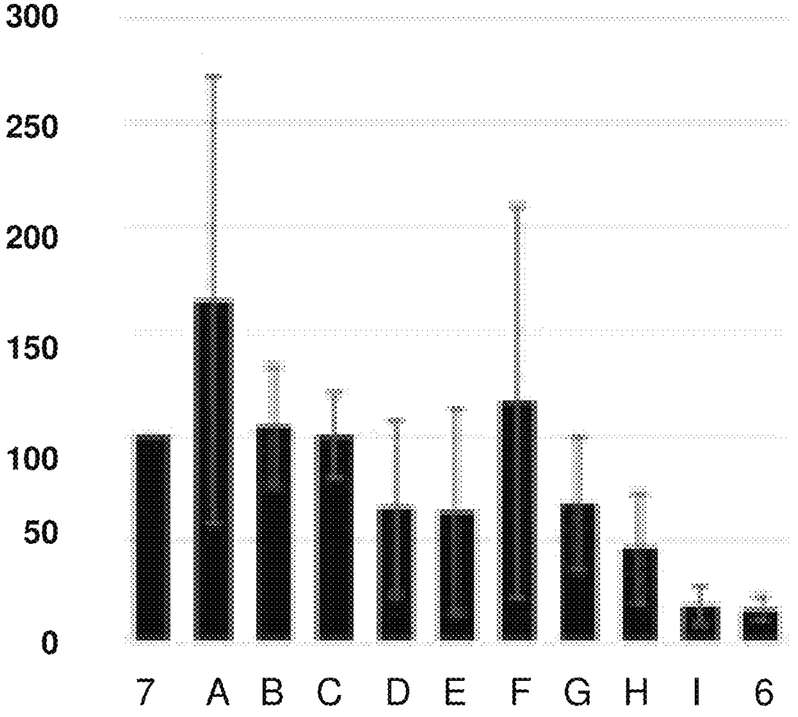

FIG. 21 is a bar graph showing the ratio of markers A, B, C, D, E (CD89), F, G, H and I in relation to CD32 in cells of GFP+ patients that have been subject to HIV reactivation. The reactivation of the virus is measured by RNAseq.

Figure 22:
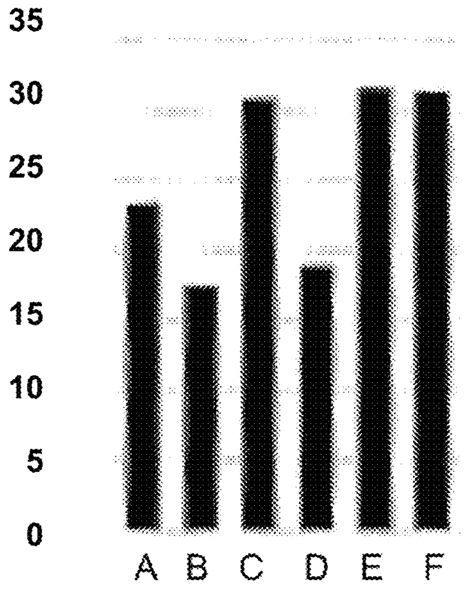

FIG. 22 is a bar graph showing the ratio of markers A, B, C, D, E (CD89), in CD32-cells in cells of GFP+ patients that have been subject to HIV reactivation. These markers are mutually exclusive with CD32.

Figure 23:
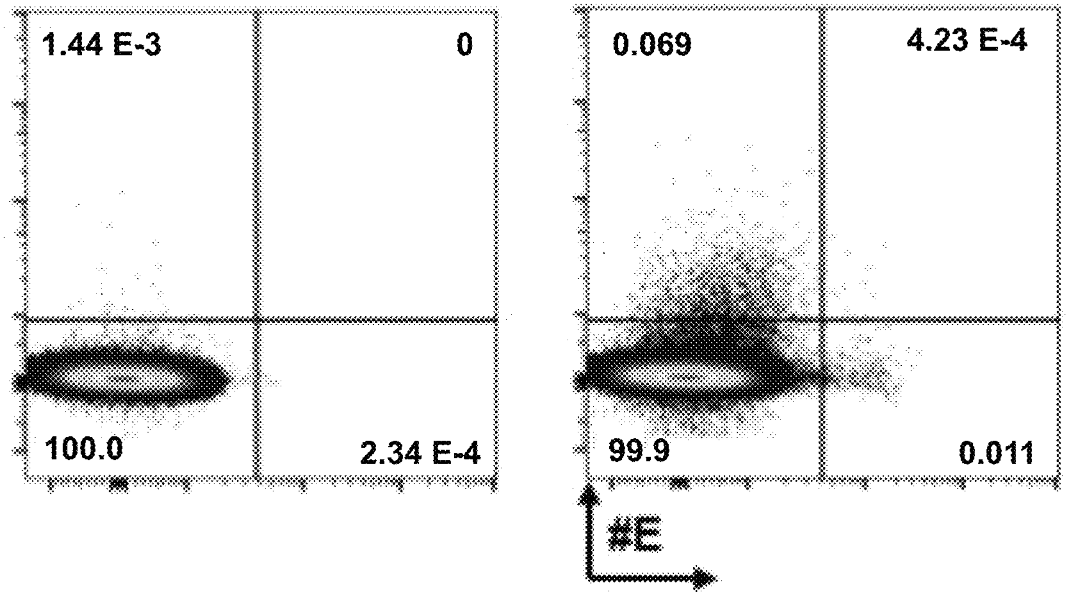

FIG. 23 shows flow-cytometry results on TCD4 cells from a patient (patient 812) marked with CD32 and CD89 antibodies (bottom right-hand image) or with isotypes (left-hand image) and the detection of the single-marked (CD32 or CD89) cells and double-marked (CD32 and CD89) cells. It is noted that the two populations are exclusive and that no double marking has been detected.

FIG. 24 shows staining of primary human cells with panel of monoclonal anti-CD89 and results of ELISA tests (Table).

Figure 25:
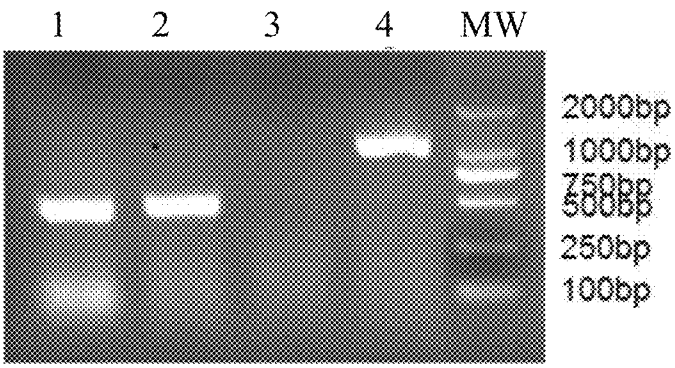

FIG. 25 shows the VH and VL PCR amplification results. 1: Mouse κ primers, 2: Mouse IgG primers, 3: Mouse λ primers, 4: positive control (GAPDH primers).

Figure 26:
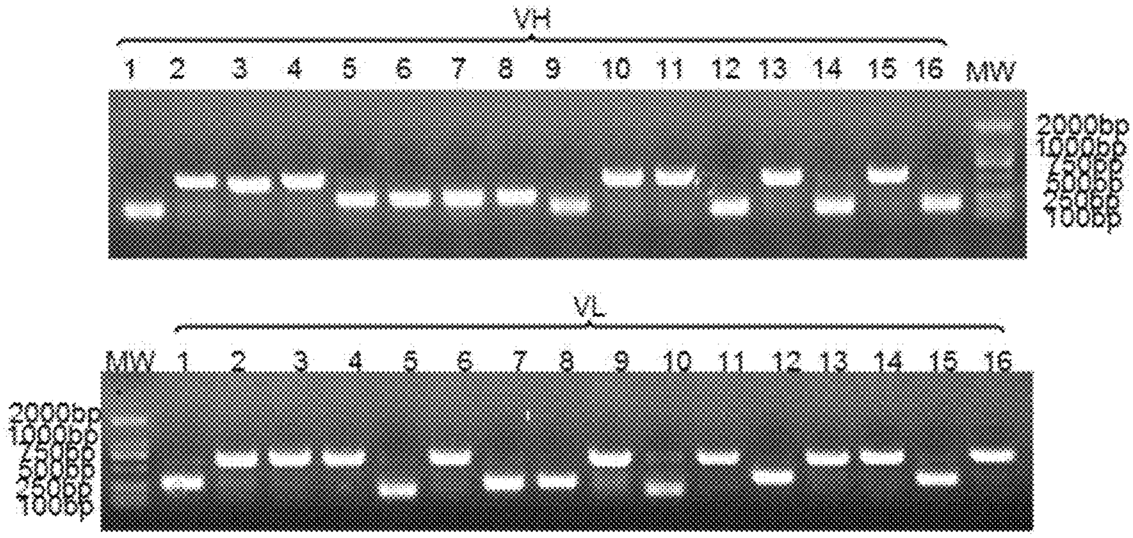

FIG. 26 shows the PCR validation after cloning. Clones 2, 3, 4, 10, 11, 13, 15 of VH and clones 2, 3, 4, 6, 9, 11, 13, 14, 16 of VL were selected for sequencing.

DETAILED DESCRIPTION

Using an approach described in the examples below, the inventors have shown that certain specific CD markers were of particular interest for detecting the lentivirus cellular reservoirs.

In the invention, cellular reservoirs are understood to mean cells in which viral forms capable of replication accumulate and persist with replacement kinetics that are slower than that of viral forms that are replicating actively.

The markers of particular interest are as follows: the CD123 marker (Gene ID: 3563), the CD87 marker (Gene ID: 5329), the CD89 marker (Gene ID: 2204), the CD172a marker (Gene ID: 140885), the CD112 marker (Gene ID: 5819), the CD213a1 marker (Gene ID: 3597), the CD120b marker (Gene ID: 7133), the CD121a marker (Gene ID: 3554), the CD54 marker (Gene ID: 3383), the CD11c marker (Gene ID: 3687), the FPRL1 marker (Gene ID: 2358) and the CD32 marker (CD32a Gene ID: 2212; CD32b Gene ID: 2213).

The CD123 marker or antigen is also known as an alpha sub-unit of the human interleukin-3 receptor. It is a type I transmembrane glycoprotein and a member of the superfamily of cytokine receptors. The CD123 forms a heterodimer with the CD131 antigen (the beta sub-unit of the interleukin-3 receptor) in order to form the interleukin-3 receptor. Within the receptor, it is the CD123 antigen that imparts the specificity to cytokine. In humans, for example, this antigen is coded by the gene contained in the sequence SEQ ID NO: 27. The antigen is in particular formed by the sequence of amino acids represented by the sequence SEQ ID NO: 1, itself coded by the nucleic acid molecule (cDNA) represented by the sequence SEQ ID NO: 14.

The CD87 marker or antigen is also known as the urokinase-type plasminogen activator receptor or uPAR. CD87 is a major participant involved in the migration of the angiogenic endothelium. In humans, for example, this antigen is coded by the gene contained in the sequence SEQ ID NO: 28. The antigen is in particular formed by the sequence of amino acids represented by the sequence SEQ ID NO: 2, itself coded by the nucleic acid molecule (cDNA) represented by the sequence SEQ ID NO: 15.

The CD89 marker is a receptor of the constant Fc regions of class A immunoglobulins (IgA). A transmembrane glycoprotein receptor, it is expressed on the surface of myeloid lineage cells, such as neutrophilic cells, monocytes, macrophages and eosinophils, within which it participates in mediating the immune response to pathogens. In humans, for example, this antigen is coded by the gene contained in the sequence SEQ ID NO: 29. The antigen is in particular formed by the sequence of amino acids represented by the sequence SEQ ID NO: 3, itself coded by the nucleic acid molecule (cDNA) represented by the sequence SEQ ID NO: 16.

The CD172a or SIRP α antigen (signal regulatory protein a antigen) is a membrane glycoprotein that is predominantly expressed by myeloid cells, stem cells and neurons. This antigen acts as an inhibitor receptor, which interacts with the CD47 antigen with the aim of regulating the phagocytosis of the cells. In humans, for example, this antigen is coded by the gene contained in the sequence SEQ ID NO: 30. The antigen is in particular formed by the sequence of amino acids represented by the sequence SEQ ID NO: 4, itself coded by the nucleic acid molecule (cDNA) represented by the sequence SEQ ID NO: 17.

The CD112 antigen is a membrane glycoprotein that is also known as nectin-2. It is also known as PVRL2 (poliovirus receptor-related 2) or HVEB (herpesvirus entry mediator B), owing to its involvement in the entry of the polio or herpes viruses. In humans, for example, this antigen is coded by the gene contained in the sequence SEQ ID NO: 31. The antigen is in particular formed by the sequence of amino acids represented by the sequence SEQ ID NO: 5, itself coded by the nucleic acid molecule (cDNA) represented by the sequence SEQ ID NO: 18.

The CD213a1 antigen is also known as being the alpha-1 chain of the interleukin-13 receptor (IL13RA1). This subunit of the receptor participates in signal transduction via the JAK/STAT pathway. In humans, for example, this antigen is coded by the gene contained in the sequence SEQ ID NO: 32. The antigen is in particular formed by the sequence of amino acids represented by the sequence SEQ ID NO: 6, itself coded by the nucleic acid molecule (cDNA) represented by the sequence SEQ ID NO: 19.

The CD120 antigen corresponds to the tumor necrosis factor receptor 2 (TNFR2). In humans, for example, this antigen is coded by the gene contained in the sequence SEQ ID NO: 33. The antigen is in particular formed by the sequence of amino acids represented by the sequence SEQ ID NO: 7, itself coded by the nucleic acid molecule (cDNA) represented by the sequence SEQ ID NO: 20.

The CD121a antigen corresponds to the interleukin 1 receptor type 1 (IL1R1) and participates in the immune and inflammatory response linked to IL1. In humans, for example, this antigen is coded by the gene contained in the sequence SEQ ID NO: 34. The antigen is in particular formed by the sequence of amino acids represented by the sequence SEQ ID NO: 8, itself coded by the nucleic acid molecule (cDNA) represented by the sequence SEQ ID NO: 21.

The CD54 antigen is also known as an intercellular adhesion molecule 1 (ICAM-1). ICAM-1 is a cell surface glycoprotein expressed in endothelial cells and immune system cells that interact with integrins. ICAM-1 is also used by the rhinovirus to enter target cells. In humans, for example, this antigen is coded by the gene contained in the sequence SEQ ID NO: 35. The antigen is in particular formed by the sequence of amino acids represented by the sequence SEQ ID NO: 9, itself coded by the nucleic acid molecule (cDNA) represented by the sequence SEQ ID NO: 22.

The CD11c antigen is a type I transmembrane protein that is highly expressed in dendritic cells, but also expressed by monocytes, macrophages, neutrophils and some lymphocyte B cells. In humans, for example, this antigen is coded by the gene contained in the sequence SEQ ID NO: 36. The antigen is in particular formed by the sequence of amino acids represented by the sequence SEQ ID NO: 10, itself coded by the nucleic acid molecule (cDNA) represented by the sequence SEQ ID NO: 23.

The FPRL1 antigen is also known as N-formyl peptide receptor 2. This is a receptor with low affinity for N-formylmethionyl peptides, which are chemoattractants of neutrophils, subsequently inducing the activation thereof. In humans, for example, this antigen is coded by the gene contained in the sequence SEQ ID NO: 37. The antigen is in particular formed by the sequence of amino acids represented by the sequence SEQ ID NO: 11, itself coded by the nucleic acid molecule (cDNA) represented by the sequence SEQ ID NO: 24.

The CD32 antigen is an immunoglobulin G membrane receptor expressed by the vast majority of lymphocyte B cells. CD32 participates in the regulation of the production of immunoglobulins during overproduction. In humans, for example, this antigen is coded by the gene contained in the sequence SEQ ID NO: 38 or SEQ ID NO: 39. The antigen is in particular formed by the sequence of amino acids represented by the sequence SEQ ID NO: 12 (CD32a) or SEQ ID NO: 13 (CD32b), itself coded respectively by the nucleic acid molecule (cDNA) represented by the sequence SEQ ID NO: 25 or SEQ ID NO: 26.

In the invention, when CD (cluster of differentiation) molecules are mentioned, these molecules will be interchangeably referred to as “marker”, “antigen” or “molecules”.

In addition, the invention also advantageously relates to the use of at least one of the following antigens: the CD123 marker, the CD87 marker, the CD89 marker, the CD172a marker, the CD112 marker, the CD213a1 marker, the CD120b marker, the CD121a marker, the CD54 marker, the CD11c marker, the FPRL1 marker and the CD32a marker or the CD32b marker, or both, or of a means for detecting said above-mentioned markers for the detection of cellular reservoirs of a lentivirus, said cellular reservoirs being as defined above.

In the invention, the lentivirus infecting the cellular reservoirs being studied are advantageously lentiviruses responsible for mammalian immunodeficiency, notably apes, notably hominids, in particular humans, and felines, notably cats (i.e. HIV 1 and 2 viruses, SIV and FIV respectively).

In addition, the invention also advantageously relates to the use of at least one antigen selected from the following antigens: the CD32 marker, in particular CD32a or CD32b, or both, the CD87 marker, the CD89 marker, the CD172a marker, the CD112 marker, the CD213a1 marker, the CD120b marker, the CD121a marker, the CD54 marker, the CD11c marker, the FPRL1 marker and the CD123 marker, for the detection of cellular reservoirs of a mammalian immunodeficiency virus, in particular a lentivirus, said cellular reservoirs being cells that are infected with said mammalian immunodeficiency virus and are unresponsive to mammalian immunodeficiency antiviral therapeutic agents.

In the invention, it is possible to use one of the above-mentioned markers, or a combination of the above-mentioned markers.

It is particularly advantageous to use the CD89 marker, in isolation or in combination with at least one of the above-mentioned markers for the above-mentioned selection.

In addition, the invention also advantageously relates to the use of at least the CD89 differentiation marker, in particular the use of the single CD89 marker, for the detection of cellular reservoirs of a mammalian immunodeficiency virus, in particular a lentivirus, said cellular reservoirs being cells that are infected with said mammalian immunodeficiency virus and are unresponsive to mammalian immunodeficiency antiviral therapeutic agents, said cells being responsible for the viral rebound after therapy is stopped, in particular tritherapy or multitherapy in humans.

In the invention (above and below), references to CD32 relate to the CD32a marker or the CD32b marker, or the two CD32a and CD32b markers.

In an advantageous embodiment, the invention relates to the above-mentioned use in which said CD89 marker consists of the protein of sequence SEQ ID NO: 3.

As shown in the examples below, the inventors have identified the CD89 marker as being specifically expressed on the surface of the cellular reservoirs, cells infected with lentiviruses that are in particular responsible for mammalian immunodeficiency.

In the invention, "unresponsive to therapeutic agents" is understood to mean that, in particular for cells infected with immunodeficiency virus, there is no significant response to the effect of a medical treatment. Unresponsiveness to therapeutic agents may be characterized by a complete absence of a response, due to viral latency or inaccessibility to therapeutic agents, which means that the effect of one or more medications is essentially the same as that of a composition that does not contain any therapeutic agent (pharmaceutically acceptable vehicle, excipient, water, or even a placebo). Unresponsiveness may also be characterized by a response that is not significantly distinct from that obtained with a composition that does not contain any therapeutic agent.

The cellular reservoirs of the invention are referred to as unresponsive to antiviral therapeutic agents since, with the current therapies used to eradicate viruses, these cells are not killed, destroyed, or induced into an apoptosis or necrosis processes, or recognized as being part of the non-self by the immune system. In the particular case of immunodeficiency viruses such as HIV (HIV1 or HIV2), SIV or FIV, the cellular reservoirs are not eliminated by the anti-retroviral agents that are currently used (entry inhibitors, inverse transcriptase inhibitors, anti-proteases, modified nucleotides, etc.).

In addition, the invention further relates to a method for the detection of cellular reservoirs of cells infected with at least one mammalian immunodeficiency virus, in particular a lentivirus, said method comprising a step of bringing, in particular in vitro or ex vivo, cells of a mammal infected with said mammalian immunodeficiency virus and in particular treated with a specific anti-retroviral therapy for said mammalian immunodeficiency virus into contact with an agent allowing the detection of lymphocyte cells expressing at least one of the following antigens on their surface: the CD123 marker, the CD87 marker, the CD89 marker, the CD172a marker, the CD112 marker, the CD213a1 marker, the CD120b marker, the CD121a marker, the CD54 marker, the CD11c marker, the FPRL1 marker and the CD32 marker.

In the invention, "cellular reservoirs of cells infected with at least one virus" is understood to mean a cell subpopulation infected with said at least one virus, said population being part of the population of infected cells. These cellular reservoirs are as defined above. "Cellular reservoirs of cells infected with at least one virus" also means cellular reservoirs of at least one virus.

The above-mentioned method proposes detecting the lentivirus cellular reservoirs by bringing lymphocyte cells of a (human or animal) subject into contact with an agent capable of specifically evidencing cells expressing at least one of the above-mentioned markers. To do this, conventional immunological methods for isolating lymphocyte cells, such as flow cytometry, which is well known to a person skilled in the art, can be used.

The agent making it possible to detect said marker is advantageously one or more antibodies. This antibody, or these antibodies if the aim is to simultaneously detect a plurality of markers, or if a plurality of antibodies of the same marker are used, may be coupled to one of the agents making it possible to detect the immune complex between the antibodies and their targets. For example, the antibodies may be coupled to luminescent or fluorescent molecules, or to enzymes catalyzing a reaction of which the products are visible to the analyst. These techniques for detecting the immune complexes are very widely known in the prior art.

Advantageously, the invention relates to a method for the detection of cellular reservoirs of cells infected with at least one immunodeficiency virus, in particular a mammalian virus, said method comprising a step of bringing, in particular in vitro or ex vivo, cells of a mammal infected with said mammalian immunodeficiency virus and treated with a specific anti-retroviral therapy for said mammalian immunodeficiency virus into contact with an agent allowing the detection of lymphocyte cells expressing at least the CD89 differentiation marker on their surface.

In an advantageous embodiment, the invention relates to the above-mentioned method in which said CD89 marker consists of the protein of sequence SEQ ID NO: 3.

Advantageously, the invention relates to a method as defined above, in which said agent that makes it possible to detect lymphocyte or myeloid cells expressing the differentiation marker CD89 on their surface is an anti-CD89 antibody.

In an advantageous embodiment, the invention relates to a method as defined above in which said mammalian immunodeficiency virus is the human immunodeficiency virus, HIV, in particular the HIV1 or HIV2 virus, simian immunodeficiency virus, SIV, or feline immunodeficiency virus, FIV.

In an advantageous embodiment, the invention relates to a method as defined above, in which the lymphocyte cells expressing the differentiation marker CD89 on their surface are TCD4 lymphocyte cells, in particular quiescent TCD4 cells. The quiescent lymphocytes are characterized in that they do not divide, have a long lifespan (weeks to years), a low transcription rate, and metabolic activity unique to them.

The invention further relates to a lymphocyte cell expressing at least one of the following markers on its surface: the CD123 marker, the CD87 marker, the CD89 marker, the CD172a marker, the CD112 marker, the CD213a1 marker, the CD120b marker, the CD121a marker, the CD54 marker, the FPRL1 marker, the CD11c marker, and the CD32 marker, said cell comprising, in its nuclear deoxyribonucleic acid, the genome of at least one mammalian immunodeficiency virus, said genome of at least one mammalian immunodeficiency virus being genetically modified and not existing naturally in nature.

The cells are new and do not exist in the natural state. These cells are cells in which a modified lentivirus has been inserted into the genome. These cells are human, simian, or feline cells. These cells are also isolated.

Advantageously, the invention further relates to a lymphocyte cell expressing at least the CD89 differentiation marker on its surface, said cell comprising, in its nuclear deoxyribonucleic acid, the genome of at least one mammalian immunodeficiency virus, said genome of at least one mammalian immunodeficiency virus being genetically modified and not existing in the natural state in mammals without human intervention.

In an advantageous embodiment, the invention relates to the above-mentioned cell, in which said CD89 marker consists of the protein of sequence SEQ ID NO: 3.

Advantageously, the invention relates to an above-mentioned cell, in which said genome of at least one genetically modified mammalian immunodeficiency virus makes it possible to express a fluorescent marker protein.

In particular, the above-mentioned cells are characterized in that they are lymphocyte cellular reservoirs that express the CD89 antigen on their surface, and that have integrated a lentivirus responsible for an immunodeficiency into their genome, the lentivirus having been genetically modified such that, apart from the genes responsible for the life cycle of the virus, one or more genes coding marker proteins, such as GFP or its derivatives, have been inserted.

The invention also advantageously relates to a kit, or pack, for detecting cellular reservoirs of a mammalian immunodeficiency virus, comprising at least one detecting agent or allowing the detection of at least one of the following markers: the CD123 marker, the CD87 marker, the CD89 marker, the CD172a marker, the CD112 marker, the CD213a1 marker, the CD120b marker, the CD121a marker, the CD54 marker, the CD11c marker, the FPRL1 marker and the CD32 marker, on the surface of the cells and at least one composition making it possible to determine the presence of DNA of said mammalian immunodeficiency virus in the genome of said cells.

The above-mentioned detection kit therefore contains means for detecting the membrane expression of at least one of the above-mentioned markers, and means for detecting the insertion into the genome of the DNA cells of a lentivirus responsible for an immunodeficiency. The means for detecting the markers are those described above, in particular specific antibodies of said markers.

Advantageously, the invention also relates to a kit, or pack, for detecting cellular reservoirs of a mammalian immunodeficiency virus, comprising at least one agent detecting the CD89 differentiation marker on the surface of the cells and at least one composition making it possible to determine the presence of DNA of said mammalian immunodeficiency virus in the genome of said cells.

In an advantageous embodiment, the invention relates to the above-mentioned kit, in which said CD89 marker consists of the protein of sequence SEQ ID NO: 3.

Advantageously, the invention relates to a kit as defined above, in which said composition making it possible to determine the presence of DNA of said mammalian immunodeficiency virus in the genome of said cells comprises specific oligonucleotides of sequences of the genome of said virus, in particular for the implementation of a polymerase chain reaction or PCR.

In light of the knowledge which has built up since the discovery of the HIV, SIV, and FIV viruses, a person skilled in the art is capable of identifying oligonucleotides that allow the presence of said viruses to be identified in the genome of the cell. The use of oligonucleotide pairs that allow a PCR reaction to be carried out is particularly advantageous, but a person skilled in the art can, if desired, make use of other molecular biology techniques such as a Southern blot.

In another aspect, the invention relates to a method for making a prognosis, in particular in vitro, on the relapse of a mammalian immunodeficiency following the cessation of treatment with antiviral therapeutic agents responsible for the mammalian immunodeficiency, said method comprising a step of quantifying the lymphocyte cells expressing at least one of the following antigens on their surface: the CD123 marker, the CD87 marker, the CD89 marker, the CD172a marker, the CD112 marker, the CD213a1 marker, the CD120b marker, the CD121a marker, the CD54 marker, the CD11c marker, the FPRL1 marker and the CD32 marker, and having in their genome DNA of a virus responsible for said mammalian immunodeficiency.

The prognosis method of the invention is based on the detection or absence of detection of lentivirus cellular reservoirs.

Following the cessation of antiviral treatment against HIV, the virus re-emerges and the pathology (immunodeficiency) reappears. If the patient is treated both with an antiviral treatment and with a treatment that aims to eradicate the cellular reservoirs, following the cessation of antiviral treatment it is necessary to determine the likelihood of the disease re-emerging in the patient due to the reactivation of the virus. In addition, in the context of the invention, using the means described for detecting the cellular reservoirs, it would be possible to measure the quantity of residual cellular reservoirs following the above-mentioned treatments (antiviral treatment and anti-cellular reservoir treatment). If the patient has a very low quantity of cellular reservoirs, or they no longer have any cellular reservoirs, the prognosis would be very favorable in this case; the disease would be unlikely to re-emerge in the short term. By contrast, if numerous cellular reservoirs are still present, the diagnosis would not be favorable, and the relapse of the patient would be rapid.

Advantageously, the invention also relates to a method for making a prognosis, in particular in vitro, on the relapse of a mammalian immunodeficiency following the cessation of treatment with antiviral therapeutic agents responsible for said mammalian immunodeficiency, said method comprising a step of quantifying the lymphocyte cells expressing on their surface at least the CD89 marker, and having in their genome DNA of a virus responsible for said mammalian immunodeficiency.

In an advantageous embodiment, the invention relates to the above-mentioned method in which said CD89 marker consists of the protein of sequence SEQ ID NO: 3.

In addition, the invention relates to a method for making a diagnosis, in particular in vitro, on the complete remission of mammalian immunodeficiency following the cessation of treatment with antiviral therapeutic agents responsible for said mammalian immunodeficiency, said method comprising a step of detecting the absence of lymphocyte cells expressing at least one of the following markers on their surface: the CD123 marker, the CD87 marker, the CD89 marker, the CD172a marker, the CD112 marker, the CD213a1 marker, the CD120b marker, the CD121a marker, the CD54 marker, the CD11c marker, the FPRL1 marker and the CD32 marker, and having in their genome DNA of a mammalian immunodeficiency virus.

In this diagnosis method, if the patient no longer has any HIV cellular reservoirs in their body, it would be possible to provide the diagnosis of complete remission of the viral infection, and therefore of the associated immunodeficiency. The detection of the absence of cellular reservoirs is of course carried out by the detection means according to the invention.

Advantageously, the invention also relates to a method for making a diagnosis, in particular in vitro, on the complete remission of mammalian immunodeficiency following the cessation of treatment with antiviral therapeutic agents responsible for said mammalian immunodeficiency, said method comprising a step of detecting the absence of lymphocyte cells having in their genome DNA of a mammalian immunodeficiency virus and expressing on their surface at least the CD89 marker.

In an advantageous embodiment, the invention relates to the above-mentioned method in which said CD89 marker consists of the protein of sequence SEQ ID NO: 3.

The invention also relates to a method for the detection of cellular reservoirs of cells infected with a mammalian immunodeficiency virus, said method comprising a step of bringing, in vitro or ex vivo, cells of a mammal infected with said mammalian immunodeficiency virus and in particular treated with a specific anti-retroviral therapy for said mammalian immunodeficiency virus and/or a therapy aiming to eradicate said cellular reservoirs into contact with an agent allowing the detection of the lymphocyte cells expressing an above-mentioned differentiation marker, in particular the CD89 marker, on their surface.

The invention also relates to a method for the evaluation of the efficacy of a treatment aiming to eradicate cellular reservoirs of mammalian cells infected with said mammalian immunodeficiency virus, said method comprising a step of detecting, in vitro or ex vivo, said cellular reservoirs using an agent allowing the detection of the presence, quantity or absence of lymphocyte cells expressing the CD89 differentiation marker on their surface.

Advantageously, the invention relates to the above-mentioned method, further comprising a step of classifying said infected mammals in accordance with the presence, absence or quantity of detected cellular reservoirs.

In this method, the cellular reservoirs are sought following a treatment that aims to destroy them. If the cellular reservoirs are still present in a number that is substantially identical to that before said treatment aiming to eradicate them, the treatment has therefore not worked. If, however, the number of cellular reservoirs has decreased significantly, the treatment has worked, especially if it is no longer possible to identify cellular reservoirs.

In addition, the invention relates to a therapeutic agent specifically targeting the lymphocyte cellular reservoirs of lentiviruses as identified in the present invention, in particular the cellular reservoirs of the viruses responsible for mammalian immunodeficiency, such as the HIV1, HIV2, SIV and FIV viruses.

Advantageously, the therapeutic agent is an antibody or a chemical agent capable of recognizing the cellular reservoirs as identified in the present invention.

The above-mentioned therapeutic agent is more advantageously a bifunctional antibody capable of recognizing both one of the following markers: the CD123 marker, the CD87 marker, the CD89 marker, the CD172a marker, the CD112 marker, the CD213a1 marker, the CD120b marker, the CD121a marker, the CD54 marker, the CD11c marker, the FPRL1 marker, the CD32 marker, and the CD3 antigen (protein associated with the specific T-cell receptor, or TCR, of the T lymphocytes), or one or more other specific markers of the T cells.

The invention advantageously relates to a multi-specific antibody that recognizes both at least one epitope of the CD89 marker and at least one marker characteristic of the lymphocyte cells, in particular the lymphocyte cells, in particular the T lymphocyte cells.

More advantageously, the invention relates to the above-mentioned multi-specific antibody, where said antibody is a bispecific antibody that specifically recognizes the CD89 antigen and the CD3 antigen.

Advantageously, in the context of the invention, the above-mentioned antibodies are monoclonal antibodies, in particular human or humanized antibodies, simian or simianized antibodies, or feline or felinized antibodies.

In the invention, multi-specific antibodies are understood to mean an antibody capable of recognizing a first antigen by its first CDR and a second antigen by its second CDR.

Advantageously, the antibody defined above is a bifunctional or bispecific antibody that recognizes the CD89 antigen and the CD3 antigen.

In the invention, bifunctional or bispecific antibody is understood to mean a recombinant antibody having a hypervariable region that recognizes a specified epitope, and a second hypervariable region that recognizes a second epitope, which is different from the first. Therefore, a bifunctional or bispecific antibody is capable of simultaneously recognizing two different proteins. These antibodies may also be in the form of their fragments, such as bispecific scFvs, bispecific bi-scFVs, bispecific minibodies or bispecific diabodies.

These bispecific antibodies or their fragments are advantageously humanized for use in human therapy. Humanization, which is well known in the prior art, involves replacing the entire structure of the antibody with human sequence molecules to which the hypervariable regions of interest are grafted, which generally originate from monoclonal antibodies of mice.

In addition, the invention advantageously relates to monoclonal antibody, in particular a humanized antibody, or one of its above-mentioned fragments, capable of simultaneously recognizing both one of the following markers: the CD123 marker, the CD87 marker, the CD89 marker, the CD172a marker, the CD112 marker, the CD213a1 marker, the CD120b marker, the CD121a marker, the CD54 marker, the CD11c marker, the FPRL1 marker, the CD32 marker, and the CD3 marker.

In the invention, the antibodies used may be coupled to active agents such as toxins (for example ricin or the maytansine DM1 derivative), radioisotopes (for example yttrium-90 or 90Y (pure emitter of beta-minus radiation) and iodine-131 or 131I (beta-minus and gamma emitter)), biological agents, drugs or enzymes. The therapeutic efficacy is thus predominantly based on the coupled agent, the antibody having the role of a vector to guide the agent towards the target.

The invention also relates to a bispecific antibody both to one of the following markers: the CD123 marker, the CD87 marker, the CD89 marker, the CD172a marker, the CD112 marker, the CD213a1 marker, the CD120b marker, the CD121a marker, the CD54 marker, the CD11c marker, the FPRL1 marker, and the CD32 marker, and to a specific T-cell marker, in particular the CD3 marker, for its use in the treatment of an infection by a lentivirus, in particular an infection linked to HIV or SIV.

More advantageously, the invention relates to a bispecific antibody both to CD89 and CD3, for its use in the treatment of an infection by a lentivirus, in particular an infection linked to HIV, SIV or FIV.

The invention further relates to a composition comprising at least one agent that recognizes the lymphocyte cells expressing the CD89 marker, for its use in eradicating cellular reservoirs of cells infected by a mammalian immunodeficiency virus.

Advantageously, the invention relates to the above-mentioned composition, where said agent is at least one antibody that recognizes the CD89 marker, in particular a monospecific antibody of the CD89 marker, or a multi-specific antibody that recognizes at least one epitope of the CD89 marker and at least one marker characteristic of the lymphocyte cells, in particular the T lymphocyte cells, for its above-mentioned use.

As indicated above, the antibodies coupled to toxic agents may be advantageous for eradicating the cellular reservoirs.

The invention also relates to a composition comprising both a bispecific antibody as defined above, and a combination of anti-retroviral agents, in particular for its use in the treatment of an infection by a lentivirus, in particular an infection linked to HIV or SIV, and potentially a composition that eradicates the cellular reservoirs.

Advantageously, the invention relates to a composition for its above-mentioned use, in which the specific antibody and the combination of anti-retroviral agents are used simultaneously, separately, or so as to be staggered over time.

A method for treating infections by lentiviruses, in particular lentiviruses causing mammalian immunodeficiency, is also described, comprising administering an effective dose of the above-mentioned composition to an infected mammal, in particular a human infected with HIV.

The invention also relates to an antibody that specifically recognizes the CD89 marker expressed on the lymphocyte cellular reservoirs of lentiviruses, for its use in the treatment of an infection by a lentivirus, in particular an infection linked to HIV, SIV or FIV.

Advantageously, the above-mentioned antibody is an anti-CD89 antibody, potentially coupled to a cytotoxic agent, or an antibody that is at least bispecific and recognizes lymphocyte cells, in particular the CD3 marker, in addition to the CD89 marker and at least one other specific marker.

The invention also relates to an above-mentioned composition, for its use in the treatment of an infection by a lentivirus, in particular an infection linked to HIV, SIV or FIV.

Advantageously, the invention relates to a composition for its above-mentioned use, in which the specific antibody and the combination of anti-retroviral agents are used simultaneously, separately, or so as to be staggered over time.

The invention also relates to a method for the evaluation of the efficacy of a drug aiming to eradicate a cellular reservoir of mammalian cells infected with a mammalian immunodeficiency virus, said method comprising:

a) quantifying, in a biological sample obtained from a mammal, the presence of lymphocyte cells expressing a CD32a differentiation marker on their surface, in order to obtain the number NI of lymphocyte cells expressing the CD32a differentiation marker on their surface in the biological sample;
   - wherein the mammal is infected by the mammalian immunodeficiency virus;
   - wherein the mammal infected by the mammalian immunodeficiency virus has been treated with an effective amount of the drug;
   - wherein the lymphocytes cells expressing the CD32a differentiation marker on their surface are detected by means of an agent allowing the detection of the CD32a differentiation; and b) concluding that the drug is efficient to eradicate the cellular reservoir of mammalian cells infected with the mammalian immunodeficiency virus when the number NI is equal to 0, otherwise, the efficacy of the drug is not established.

According to this aspect of the invention, it is proposed a method allowing the evaluation of the efficacy of a treatment intending to eradicate reservoir cells, and therefore completely eradicating the virus from its mammal host.

For this purpose, detection of lymphocytes expressing CD32a marker is carried out and the number of these cells is evaluated. As CD32a in lymphocyte cells is the hallmark of viral reservoir, the absence of this kind of cells is the testimony of the absence of reservoir cells. Therefore, when evaluating the amount of CD32a+ lymphocyte cells in a patient infected by the virus, and having received the drug, if no CD32a+ lymphocyte cell is observed, then it can be stated that the drug has eradicated reservoir cells.

In one embodiment, the invention relates to the method as defined above, the method comprising a1) quantifying, in a biological sample obtained from a mammal, the presence of lymphocyte cells expressing a CD32a differentiation marker on their surface, in order to obtain the number NI of lymphocyte cells expressing the CD32a differentiation marker on their surface in the biological sample;
   - wherein the mammal is infected by the mammalian immunodeficiency virus;
   - wherein the mammal infected by the mammalian immunodeficiency virus has been treated with an effective amount of the drug;
   - wherein the lymphocytes cells expressing the CD32a differentiation marker on their surface are detected by means of an agent allowing the detection of the CD32a differentiation;

a2) comparing the number NI of lymphocyte cells expressing a CD32a differentiation marker on their surface to the number NIC of lymphocyte cells expressing a CD32a differentiation marker on their surface in a biological sample originating from an healthy mammal, in order to obtain a ratio NI/NIC;
   - wherein the healthy mammal is not infected by the mammalian immunodeficiency virus;
   - wherein the mammal and the healthy mammal are of the same nature; and b) concluding that the drug:
   - is efficient to eradicate the cellular reservoir of mammalian cells infected with the mammalian immunodeficiency virus when the ratio NI/NIC is lower than 1, and
   - is not efficient to eradicate the cellular reservoir of mammalian cells infected with the mammalian immunodeficiency virus when the ratio NI/NIC is at least equal to 1.

In this embodiment, the amount of CD32a+ lymphocyte cells is compared to the amount of CD32a+ lymphocyte cells in a healthy mammal. The healthy mammal is suspected to have no or a low amount of healthy CD32a+ lymphocyte cells.

It is to be noticed that the healthy mammal can correspond to the mammal who received the drug, but before its infection by the virus, or another mammal that was never infected by the virus, or a compilation of data (i.e. mean number CD32a+ lymphocyte cells) of from many mammal that were never be infected by the virus.

In one embodiment, the invention relates to the method as defined above, the method comprising:

a1) quantifying, in a biological sample obtained from a mammal, the presence of lymphocyte cells expressing a CD32a differentiation marker on their surface, in order to obtain the number NI of lymphocyte cells expressing the CD32a differentiation marker on their surface in the biological sample;
   - wherein the mammal is infected by the mammalian immunodeficiency virus;
   - wherein the mammal infected by the mammalian immunodeficiency virus has been treated with an effective amount of the drug;

wherein the lymphocytes cells expressing the CD32a differentiation marker on their surface are detected by means of an agent allowing the detection of the CD32a differentiation, a3) comparing the number NI of lymphocyte cells expressing a CD32a differentiation marker on their surface to the number NIi of lymphocyte cells expressing a CD32a differentiation marker on their surface in a biological sample originating from the mammal before the administration of the drug, in order to obtain a ratio NI/NIi;

wherein the mammal and the healthy mammal are of the same nature; and b) concluding that the drug is efficient to eradicate the cellular reservoir of mammalian cells infected with the mammalian immunodeficiency virus when the ratio NI/NIi is lower than 1, and is not efficient to eradicate the cellular reservoir of mammalian cells infected with the mammalian immunodeficiency virus when the ratio NI/NIi is at least equal to 1.

In this embodiment, the amount of CD32a+ lymphocyte cells is compared to the amount of CD32a+ lymphocyte cells of the mammal, but before its treatment by the drug. Thus, if the amount of CD32a+ lymphocyte cells after treatment is lower than the number of CD32a+ lymphocyte cells, or equals to 0, then the drug has eradicated the reservoir cells. Otherwise, this means that the drug had no effects on the survival of CD32a+ lymphocyte cells.

Advantageously, the invention relates to the method as defined above, wherein the mammal is a human, a monkey or a cat.

Advantageously, the invention relates to the method as defined above, wherein the mammalian immunodeficiency virus is a human immunodeficiency virus, a Simian immunodeficiency virus, or a Feline immunodeficiency virus.

Advantageously, the invention relates to the method as defined above, wherein the human immunodeficiency virus is HIV1 or HIV2.

Advantageously, the invention relates to the method as defined above, wherein the lymphocytes cells expressing the CD32a differentiation marker on their surface are T lymphocytes cells.

Advantageously, the invention relates to the method as defined above, wherein the lymphocytes cells are TCD4+ CD89− cells.

Advantageously, the invention relates to the method as defined above, wherein the agent allowing the detection of the presence, quantity or absence of lymphocytes cells expressing the CD32a differentiation marker on their surface is an antibody specifically recognizing the CD32a marker.

Advantageously, the invention relates to the method as defined above, wherein the antibody is a monoclonal antibody.

Advantageously, the invention relates to the method as defined above, wherein the monoclonal antibody is a human or humanized antibody.

Advantageously, the invention relates to the above-defined method, wherein the antibody is a monoclonal antibody is an antibody interacting with the peptide consisting of the sequence as set forth in SEQ ID NO: 40.

The invention also relates to an anti-CD32a antibody that does not recognize a CD32b marker, wherein the anti-CD32a antibody is a murine antibody comprising, an heavy chain comprising complementarity determining region (CDR) sequences as set forth as SEQ ID NOs: 44-46, and a light comprising CDR sequences as set forth in SEQ ID NO: 49, the sequence KVA and SEQ ID NO: 50.

Advantageously, the antibody comprises a variable region of its heavy chain comprising an amino acid sequence as set forth in SEQ ID NO: 43 and a variable region of its light chain having an amino acid sequence as set forth in SEQ ID NO: 47.

More advantageously, the antibody is a chimeric or humanized antibody.

More preferably, the antibody also comprises CDRs specific to an antigen of a CD3 differentiation marker. In other words, the antibody comprises an heavy chain comprising complementarity determining region (CDR) sequences as set forth as SEQ ID NOs: 44-46, and a light comprising CDR sequences as set forth in SEQ ID NO: 49, the sequence KVA and SEQ ID NO: 50, and an heavy and a light chain comprising CDR recognizing a CD3 antigen.

The invention will be better understood in the light of the experimental data set out below and the figure illustrating this.

EXAMPLES

Example 1—Identification of Specific Markers of the Cellular Reservoirs

The problem addressed by the invention is to identify and validate a specific marker of the infected cells by means of an in vitro model and the ex vivo phenotypic exploration of the primary cells of patients infected with HIV-1 on effective antiviral (anti-retroviral) treatment. The in vitro and ex vivo evidence of a specific expression, in particular of the CD32 marker, on the surface of the infected cells may be utilized to target and eliminate the viral reservoir in patients infected with HIV-1, and thus to propose an effective therapy that allows the virus to be definitively eradicated in the infected patients.

Material and Methods

1. Viral Production and VLPs

The VLPs containing Vpx and viral particles were produced following the standard protocol for calcium phosphate transfection of DNA in the 293T cells. The VLP-Vpx were produced by co-transfecting 8 μg of pSIV3+ plasmid and 2 μg of pMD2-G VSV-G plasmid. The culture medium was replaced 16 hours post-transfection before retrieving the VLPs 48 hours later, centrifuging them, filtering them on a 0.45 mm filter, and concentrating them 100× by ultracentrifugation. The HIV-1-CMV-eGFP viral particles were produced by co-transfecting 5 μg of pHRET plasmid, 5 μg of psPAX2 packaging plasmid, and 2 μg of pMD2-G plasmid. After concentration, the p24 titer of the viral stock was measured by ELISA and the infectious titer (MOI) was measured by titration on 293T cells.

2. Infection and "Sorting" of the Quiescent Infected TCD4+ Lymphocytes In Vitro

The peripheral blood mononuclear cells from healthy donors were isolated by density gradient (Ficoll), then cultivated on a 24-well plate in the presence of VLP-Vpx for 12 hours at a concentration of $2.10^6$ cells/well in final 300 μl of complete medium (RPMI 10% SVF). The cells were then infected by adding HIV-1-CMV-eGFP (1 μg p24 equivalent to an MOI of 10×). As a control, cells were cultivated exclusively in the presence of VLP-Vpx, HIV-1-CMV-egFP, or were left untreated. Three days post-infection, the quiescent infected (XH+) TCD4+ cells (CD69− HLA-DR−), the quiescent TCD4+ cells treated exclusively with HIV-1-CMV-eGFP (XH−), and the controls (X or NT) were isolated by means of a sorter. The sorted cells were re-suspended in RA1 buffer with added beta-mercaptoethanol, and stored at −80° C. before total RNA extraction.

3. Total RNA Sequencing and Bioinformatic Analysis

The total RNA originating from the XH+, XH−, X and NT fractions was extracted using the GE Healthcare Illustra RNA mini kit. The quality of the RNA was analyzed on the 2100 Bioanalyzer from Agilent and by means of RNA Nanochip. An Illumina library was then established. The samples were multiplexed before sequencing. A principal component analysis of the regularized-log transformed gene expression counts was carried out for the different fractions.

4. Isolation of the Peripheral Blood Mononuclear Cells from HIV-1 Patients

The peripheral blood mononuclear cells from HIV-1 patients treated effectively (viral load <20 copies of RNA HIV-1/ml blood) were isolated by density gradient (Ficoll).

5. Flow Cytometry and "Sorting" of the Sub-Populations of TCD4+ Lymphocytes

The cells originating from the in vitro infections of the peripheral blood from healthy donors and HIV-1 patients were marked using anti-CD3, anti-CD4, anti-CD32, anti-HLA-DR, and anti-CD69 antibodies, and analyzed by FACS. The fresh cells from HIV-1 patients were marked using anti-CD3, anti-CD4, anti-CD32, and anti-HLA-DR antibodies, and an IgG2 isotype control in order to be sorted using the SH800 (Sony) as a function of the expression of the CD32 marker (total TCD4+; TCD4+CD32−; TCD4+CD32low; TCD4+CD32+). For each sub-population, a portion of the sorted cells were kept at −80° C. in dry pellets for quantification of the total HIV-1 DNA, and a second portion was cultivated for inducibility and viral amplification tests.

6. Quantification of the Total HIV-1 DNA

The DNA of the different fractions isolated from the blood of HIV-1 patients was purified using the QIAamp DNA micro kit (Qiagen). The DNA concentration was determined by beta-globin qPCR. The number of copies of total HIV-1 DNA per cell was determined by ultra-sensitive qPCR (Bicentric).

DETAILED DESCRIPTION

To identify marker candidates, the inventors developed an in vitro model that allows quiescent TCD4 lymphocytes originating from healthy donors to be infected for the first time. In fact, these cells are not permissive to infection by HIV-1 without a prior activation signal (activation by TCR or PHA/IL2). The inventors identifying the SAMHD1 protein, which is responsible for the restriction in these cells, allowed them to develop a treatment by means of VLPs containing the Vpx protein (coded by the SIVmac251 virus) allowing the restriction to be removed and allowing direct infection, without there needing to be an activation signal. Using this model (FIG. 1) in which PBMCs from healthy donors were treated with VLP-Vpx and then infected with HIV-1-CMV-GFP, the total RNA of the infected cells (GFP+) was extracted in order to carry out RNA-seq experiments on the messenger RNA. PBMCs that was treated with VLP-Vpx but was not infected, as well as non-infected cells, were used as a control. A statistical and bioinformatic analysis made it possible to determine the impact of the HIV-1 infection on the transcriptional program of the quiescent TCD4 lymphocytes.

In fact, the principal component analyses (PCAs) (FIG. 2) and the hierarchical clustering HC (FIG. 3) were carried out on the basis of the RNA-seq results. The two analyses, PCA and HC, carried out on four donors, evidenced that the VLP-Vpx-treated and infected cells (VLP-Vpx GFP+) formed a distinct cluster of the control cells (VLP-Vpx GFP−, VLP-Vpx only, and non-infected). These results indicate that the VLP-Vpx GFP+ cells from different donors share a signature that distinguishes them from the other populations. During infection, the HIV-1 therefore modulates the genetic expression of the quiescent TCD4 lymphocytes and could translate into a phenotypic profile distinguishing them from the non-infected cells.

The inventors were therefore interested in the differentially expressed genes (DE genes) and in particular in the up-regulated genes during the latent infection (FIGS. 4 and 5). Therefore, 22 marker candidates corresponding to surface proteins were selected for validation in vitro. By using the in vitro model on PBMCs from healthy donors, the expression of 22 markers was tested by FACS analysis (FIG. 6) on the quiescent infected TCD4 lymphocytes. The results are presented in percentage expression of the markers (#1 to #22) on the GFP+ infected cells and the non-infected cells (GFP−). The analysis revealed specific expression of the CD32 marker (marker #7) on the infected cells in comparison with the control cells (FIGS. 7 and 8). The identification of a marker candidate was therefore focused on the CD32 marker.

FIG. 21 shows that 9 other markers are also expressed on the surface of the TCD4 cells of patients who are infected and are susceptible to viral relapse.

Continuing analysis on new donors made it possible to confirm the induction of the specific expression of the CD32 marker in the infected cells in a latent manner with enrichment in the level of expression of this marker in the GFPhigh populations (FIGS. 9A and 9B, and 10A and 10B). The inventors have also showed that the induction of the CD32 marker is limited to the quiescent population. Indeed, cells stimulated by the TCR path (anti-CD3/anti-CD28) do not express the CD32 marker (FIGS. 11A and 11B). The use of a pseudotyped virus via the envelope of the VSV virus made it possible to demonstrate the induction of this marker on other infected populations, such as CD8 (FIG. 12). In addition, we have determined if the HIV-2 and SIV lentiviruses induce the expression of CD32 in the same way as HIV-1. FIGS. 13A and 13B show that SIV and HIV-2 are capable of inducing the expression of CD32 on the surface of the quiescent infected TCD4 cells in the presence of Vpx.

After validating the CD32 marker in vitro, the inventors sought to establish its relevance ex vivo. Therefore, phenotypic FACS analysis of the level of expression of this marker on the TCD4 lymphocytes was carried out on the PBMCs of patients who were infected and treated effectively with antivirals in comparison with healthy donors. We were able to evidence significantly higher expression of CD32 in the patients (FIGS. 14A and 14B).

Lastly, the inventors investigated the level of enrichment with HIV-1 DNA in the different sub-groups of TCD4 lymphocytes differentially expressing the CD32 marker (total TCD4, TCD4 CD32−, TCD4 CD32low and TCD4 CD32+) in two virally suppressed patients. After sorting these different populations (FIG. 15A to 15C), the genomic DNA was extracted and the total HIV-1 DNA was quantified by qPCR in the different fractions.

The results obtained for the two patients show strong enrichment in HIV-1 DNA in the TCD4 fractions expressing the CD32 marker in comparison with the TCD4s not expressing this marker (FIG. 16).

This set of in vitro and ex vivo results thus made it possible to validate CD32 as a specific marker for cells infected with HIV-1. The identification of CD32 makes it possible to establish new strategies aiming to directly target cells infected with HIV-1, to allow the viral reservoir to be purged, and to cure AIDS.

Example 2

The cellular sub-populations isolated from the blood of HIV-1 patients were cultivated in the absence or presence of activator agents such as PHA or anti-CD3, anti-CD28 and anti-CD2 beads (Miltenyi) in the presence of IL2 (50 IU/ml). The $TCD4^+$ and $TCD4^+$ $CD32^-$ fractions were cultivated on a 24-well plate at a concentration of $10^6$ cells per ml of complete medium, and the supernatants were recovered every 2 days for a p24 ELISA test.

The results are set out in the following table, and in FIG. 17:

| Patient | Infectious units per million (IUPM) of CD4 cells (95% IC) | IUPM of CD4 CD32a+ cells (95% IC) |
|---|---|---|
| 27 | 2.2 (0.51 to 9.44) | 4977 (533 to 46,400) |
| 489 | 5.5 (1.33 to 23.01) | 16,422 (1841 to 146,000) |
| 566 | 2.2 (0.51 to 9.44) | 2326 (249 to 21,700) |
| 771 | 2.2 (0.51 to 9.44) | 2158 (231 to 20,100) |

This first experiment sought to evidence that the production of new viral particles from total TCD4+ lymphocytes containing the CD32+ fraction is lower than that of TCD4+ CD32+ cells, which shows that the viral reservoirs are CD32a+ cells. The results obtained show an enrichment by 3000× of the IUPM number in the TCD4+ CD32a+ cells relative to the total TCD4+ lymphocytes.

In a second experiment, TCD4+ lymphocytes isolated from the blood of 3 patients were polyclonally activated (anti-CD3/anti-CD28 plus IL2) in vitro as a viral production control. At the same time and for the same patients, TCD4+ lymphocytes depleted in cells expressing the CD32a marker were also isolated and then activated in the same conditions in vitro.

The TCD4+ CD32low and CD32+ fractions were cultivated on a round-bottomed 96-well plate before the culture supernatants are removed every 3 days to be added to 2000 MT4C5 cells for a viral amplification test by means of SIMOA, an ultra-sensitive p24 ELISA assay. This second experiment aims to demonstrate that the virus of which the production was induced by activation of the TCD4+ CD32+ and TCD4+CD32low is capable of establishing a productive infection in co-culture.

This experiment sought to evidence that it is possible to induce the production of new viral particles from total TCD4+ lymphocytes containing the CD32+ fraction, contrary to TCD4+ cells depleted in CD32+ cells.

The results are set out in FIG. 18.

The result of the comparison of the viral replication kinetics between the total TCD4+ cells (black points) and the TCD4+CD32a− cells (grey points) is that the depletion of the TCD4+ CD32a+ leads to a considerable delay in viral replication. These results confirm that the TCD4+ CD32a+ cells contribute significantly to the total reservoir of cells that are infected and are capable of viral replication.

Example 3

In this example, the inventors attempted to understand how the populations of TCD4 cells originating from patients and depleted in CD32 can always reactivate the HIV virus after activation.

Other above-described markers were tested and identified reservoirs other than those expressing CD32.

In particular, the inventors identified that populations of TCD4 CD89+ cells formed viral reservoirs. The same protocol as that in example 1 was used.

In 4 patients, the marking by means of specific antibodies made it possible to evidence the expression of CD89 on the surface of the TCD4+ lymphocytes. To demonstrate that the expression of the CD89 marker on the surface of these cells was linked to the infection thereof, the total TCD4+ lymphocytes, but also the TCD4+ CD32a− CD89− cells and the TCD4+ CD32a− CD89+ cells were isolated from these same patients as described above (fenestration strategy for a representative patient). The results are set out in FIG. 19A to 19F.

Following the same protocol as in example 1, the viral DNA present in each of these fractions was quantified by qPCR DNA HIV-1 (FIG. 20). In the patients tested, the CD89 marker indeed identifies a reservoir of infected cells (approximate median of 0.1 HIV-1 DNA copies per TCD4+ CD32a− CD89+ cell).

Example 4

To continue the study, the inventors lastly tested if the different marker candidates were co-expressed in the cells identified as being viral reservoirs.

FIG. 22 shows 6 markers, of which the CD89 markers are expressed on the surface of the TCD4 cells, which do not express CD32, these markers representing 17 to 30% of the cells that are infected with HIV and are therefore likely to reactivating said HIV.

In order to identify if the CD89 marker forms a reservoir other than that identified for CD32, the inventors tested the co-expression of CD32 and CD89 on cell populations from patients.

The results are set out in FIG. 23.

These results show that the two markers, CD32 and CD89, are mutually exclusive, and each identify a separate reservoir.

Example 5

The antibodies of the present invention, which are directed against CD32 or CD89, may be produced by various techniques that are known to a person skilled in the art, in particular those described below.

BALB/c mice are immunized with the whole human CD32 or CD89 protein or with the extracellular fragment fused to the Fc domain of the human immunoglobulins. The mice are injected by subcutaneous administration with 10 μg of the protein or fragment on day 0, day 14 and day 28 in the presence of Freund's Complete Adjuvant (first injection) or an incomplete adjuvant (second and third injections). The splenocytes of the mouse are fused to murine myeloma cells (PX63.Ag8.653; ATCC, Rockville, MD) in accordance with the above-described protocol (Salhi et al. Biochem. J. 2004). The cells are cultivated on culture plates ($10^5$ cells per well)

in a HAT medium allowing the selection of hybridomas. After 12 days, the supernatants are recovered and tested by ELISA for their binding to CD32. The cells are therefore subjected to a sub-cloning step by limit dilution, the positive clones are then subjected to a second cycle of sub-cloning by limit dilution in order to isolate, following ELISA, the purified clones having the highest affinity. These clones are then cultivated on a larger scale to produce the antibodies in vitro. The supernatants are then purified in a protein G affinity chromatography column.

The technique of phage display using modified vectors as described in WO 2007/074496 or phage display selection followed by biopanning selection (Krebber et al, (1997); WO 2006/117699) is also another alternative to obtaining high-affinity antibodies directed against CD32 or CD89.

The sequencing of the selected hybridomas or the obtained sequencing that is already known in the selected phages then makes it possible to clone the variable regions, or more particularly the CDRs responsible for specific binding to the epitope in a plasmid allowing, after transfection in producing cells such as CHO cells, the production and obtaining of chimeric, humanized or human antibodies.

Anti-CD3 antibodies are obtained by carrying out the same steps. The creation of monospecific anti-CD32 or anti-CD89 or bispecific anti-CD32/CD3 or anti-CD89/CD3 humanized or human antibodies then involves using the previously obtained sequences (hybridomas having the best affinity to the corresponding antigen (CD32 or CD89 and CD3, respectively) or bacteriophages). If the antibodies originate from hybridomas, the CDRs are modified by mutagenesis so as to optimize the amino acids that are significant for recognizing the antigen, and the structural amino acids that allow good folding of the CDRs. The step of humanization involves comparing the sequences originating from the murine hybridoma with a database of human antibody sequences, the Kabat database. The amino acids that are potentially immunogenic due to their murine nature are then modified. After humanization, if the antibodies have been obtained by hybridomas, or starting from the sequence being obtained in the case of the phage display technique, the sequences coding for the humanized/human heavy (VH) and light (VL) variable regions directed against the two antigens (CD32 or CD89 and CD3) are cloned by fusion into a eukaryotic expression vector to allow production in CHO cells.

Example 6

In order to develop a specific murine monoclonal antibody against Human CD32a using a peptide antigen CQGARSPESD (SEQ ID NO: 40), different criteria were taken into account when designing the peptide: (1) The peptide must not include residue #167 submitted to a strong polymorphism; (2) The peptide should be specific for CD32a vs CD32b as much as possible to avoid cross-reactivity of anti-CD32a antibody with human CD32b. Thus, a first step was the selection, design and synthesis of a relevant peptide. In order to enhance the immune response, the peptide to carrier conjugation technique (KLH) was used. The peptide thus produced was used in the immunization of 5 mice with an optimized protocol of 45 to 74 days (4-6 injections). The immune response was monitored by bleeding and titration tests (ELISA against the peptide and recombinant human CD32a and CD32b in parallel). Following the results of these tests, the spleen cells from the best mouse were fused with a mouse myeloma cell line. The culture of the hybridomas obtained was carried out in selective medium before the screens for the selection at the polyclonal stage of specific hybridomas against the peptide in ELISA (10×96-well plates). Further screening for clones positive against recombinant human CD32a and CD32b was performed in parallel. Only the clones positive for human CD32a and negative for human CD32b were kept in the following steps. The 10 best parental clones were then subcloned following 2-3 rounds of limiting dilutions and screening against the peptide in ELISA with additional screens for clones positive against recombinant human CD32a and CD32b in parallel. Again, only clones positive for human CD32a and negative for human CD32b are retained. Cell isotyping and cryopreservation were performed on the 5 best hybridoma clones (preparation of 4 vials per clone with $1\times10^6$ cells/vial). Finally, a production of 2 mg of antibody was carried out from a culture supernatant of the best clone using a low-endotoxin process. The antibody has thus undergone purification by ProteinA/G and elimination of endotoxins (antibody purified in PBS pH 7.5, without azide, <10 EU/mg of endotoxin).

From hybridoma 8E2, total RNA was extracted and cDNA were then synthetized by reverse transcription using oligo-dT primers and VH and VL were finally amplified by PCR. VH and VL fragments, respectively amplified by IgG degenerate primers and Kappa specific primers, could be observed by gel electrophoresis (FIG. 25), indicating that isotype is IgGK. The PCR products were then sub-cloned into a standard vector, followed by bacteria transformation, then clone picking and validation by PCR (FIG. 26), and finally sequencing of 7 positive clones for VH and 9 for VL.

The sequences are the followings

```
VH:
DNA:
                                              (SEQ ID NO: 42)
GAGGTGAAGCTGCAGGAGTCAGGACCTAGCCTGGTGCAGCCAGGAGGATCCAT

GAATCTGTCCTGTGTGGCCTCCGGCTTTACCTTCTCCACCCACTGGATGAGCTGGG

TGAGGCAGAGCCCCGAGAAGGGCCTGGAGTGGATCGCCGAGATCAGACTGAAGA

CCGATAACTACGCCACACACTACGCCGAGAGCGTGAAGGGCCTGTTTACAATCTCC

AGGGATGACTCCAAGTCCAGACTGTACCTGCAGATGAAGTCCCTGAGAACAGAGG

ATAGCGGCATCTACTACTGTACAACCCACTTCGCCTACTGGGGCCAGGGCACACTG

GTG
```

-continued

Protein:

(SEQ ID NO: 43)

EVKLQESGPSLVQPGGSMNLSCVASGFTFSTHWMSWVRQSPEKGLEWIAEIRLKT

DNYATHYAESVKGLFTISRDDSKSRLYLQMKSLRTEDSGIYYCTTHFAYWGQGTLV

The CDRs for the heavy chain consist of the following sequences

CDR1: GFTFSTHW (SEQ ID NO: 44) represented as underlined in SEQ ID NO: 43.

CDR2: IRLKTDNYAT (SEQ ID NO: 45) represented in bold in SEQ ID NO: 43.

CDR3: TTHFAY (SEQ ID NO: 46) represented in the box in SEQ ID NO: 43.

VL:

DNA:

(SEQ ID NO: 47)

GATGTTGTGATGGCCCAAAGTCCACTCTCCCTGCCTGTCAGTCTTGGAGATCAA

GCCTCCATCTCTTGCAGATCTAGTCAGAGCCTTGTGGACAGTCATGGAAACACCTA

TTTACATTGGTACCTGCAGAAGCCGGGCCAGTCTCCAAAGCTCCTGATCTACAAAG

TTGCCAACCGATTTTCTGGGGTCCCAGACAGGTTCAGTGGCAGTGGATCAGGGAC

AGATTTCACACTCAAGATCAGCAGAGTGGAGGCTGAGGATCTGGGAGTTTATTTCT

GCTCTCAAAGTACACATGTTCCTCCGGTCACGTTCGGTGCTGGGACCAAGCTGGA

GCTGAAA

Protein:

(SEQ ID NO: 48)

DVVMAQSPLSLPVSLGDQASISCRSSQSLVDSHGNTYLHWYLQKPGQSPKLLIYKV

ANRFSGVPDRFSGSGSGTDFTLKISRVEAEDLGVYFCSQSTHVPPVTFGAGTKLELK

The CDRs for the light chain consist of the following sequences

CDR1: QSLVDSHGNTY (SEQ ID NO: 49) represented as underlined in SEQ ID NO: 48.

CDR2: KVA represented in bold in SEQ ID NO: 48.

CDR3: SQSTHVPPVT (SEQ ID NO: 50) represented in the box in SEQ ID NO: 48.

Example 7

In order to develop a specific murine monoclonal antibody against Human CD89 using a peptide antigen (peptide CD89 5063-4: C+AKEGELSLPQHQSGEHP, SEQ ID NO: 41), a first step was the selection, design and synthesis of a relevant peptide. In order to enhance the immune response, the peptide to carrier conjugation technique (KLH) was used. The peptide thus produced was used in the immunization of 5 mice with an optimized protocol of 45 to 74 days (4-6 injections). The immune response was monitored by bleeding and titration tests (ELISA against the peptide and recombinant human 89). Following the results of these tests, the spleen cells from the best mouse were fused with a mouse myeloma cell line. The culture of the hybridomas obtained was carried out in selective medium before the screens for the selection at the polyclonal stage of specific hybridomas against the peptide in ELISA (10×96-well plates). Further screening for clones positive against recombinant human CD89 was performed in parallel. The 10 best parental clones were then subcloned following 2-3 rounds of limiting dilutions and screening against the peptide in ELISA with additional screens for clones positive against recombinant human CD89. Cell isotyping and cryopreservation were performed on the 5 best hybridoma clones (preparation of 4 vials per clone with $1\times10^6$ cells/vial). Finally, a production of 2 mg of antibody was carried out from a culture supernatant of the best clone using a low-endotoxin process. The antibody has thus undergone purification by ProteinA/G and elimination of endotoxins (antibody purified in PBS pH 7.5, without azide, <10 EU/mg of endotoxin).

The FIG. 24 shows results obtained for the staining of healthy donor PBMC with hybridoma supernatants. The inventors selected mAbs displaying high binding affinity to CD89+ cells (i.e. clones 3A7, 3G1 and 3G11).

The invention is not limited to the embodiments set out here, and other embodiments will be clear to a person skilled in the art.

SEQUENCE LISTING (50 sequences)

SEQ ID NO: 1 - protein, 300 aa, Homo sapiens
MVLLWLTLLLIALPCLLQTKEGGKPWAGAENLTCWIHDVDFLSCSWAVGPGAPADVQYDLYLNVANRRQQYECLHYKTDAQGTRIGCRFDDISRLSSGSQSSHILVRGRSAAFGIPCTDKFVVFSQIEILTPPNMTAKCNKTHSFMHWKMRSHFNRKFRYELQIQKRMQPVITEQVRDRTSFQLLNPGTYTVQIRARERVYEFLSAWSTPQRFECDQEEGANTRAWRTSLLIALGTLLALVCVFVICRRYLVMQRLFPRIPHMKDPIGDSFQNDKLVVWEAGKAGLEECLVTEVQVVQKT

SEQ ID NO: 2 - protein, 281 aa, Homo sapiens
MGHPPLLPLLLLLHTCVPASWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPILELENLPQNGRQCYSCKGNSTHGCSSEETFLIDCRGPMNQCLVATGTHERSLWGSWLPCKSTTALRPPCCEEAQATHV

SEQ ID NO: 3 - protein, 287 aa, Homo sapiens
MDPKQTTLLCLVLCLGQRIQAQEGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYGWYNRSPYLWSFPSNALELVVTDSIHQDYTTQNLIRMAVAGLVLVALLAILVENWHSHTALNKEASADVAEPSWSQQMCQPGLTFARTPSVCK

SEQ ID NO: 4 - protein, 504 aa, Homo sapiens
MEPAGPAPGRLGPLLCLLLAASCAWSGVAGEEELQVIQPDKSVLVAAGETATLRCTATSLIPVGPIQWFRGAGPGRELIYNQKEGHFPRVTTVSDLTKRNNMDFSIRIGNITPADAGTYYCVKFRKGSPDDVEFKSGAGTELSVRAKPSAPVVSGPAARATPQHTVSFTCESHGFSPRDITLKWFKNGNELSDFQTNVDPVGESVSYSIHSTAKVVLTREDVHSQVICEVAHVTLQGDPLRGTANLSETIRVPPTLEVTQQPVRAENQVNVTCQVRKFYPQRLQLTWLENGNVSRTETASTVTENKDGTYNWMSWLLVNVSAHRDDVKLTCQVEHDGQPAVSKSHDLKVSAHPKEQGSNTAAENTGSNERNIYIVVGVVCTLLVALLMAALYLVRIRQKKAQGSTSSTRLHEPEKNAREITQDTNDITYADLNLPKGKKPAPQAAEPNNHTEYASIQTSPQPASEDTLTYADLDMVHLNRTPKQPAPKPEPSFSEYASVQVPRK

SEQ ID NO: 5 - protein, 538 aa, Homo sapiens
MARAAALLPSRSPPTPLLWPLLLLLLLETGAQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGGIIGGIIAAIIATAVAATGILICRQQRKEQTLQGAEEDEDLEGPPSYKPPTPKAKLEAQEMPSQLFTLGASEHSPLKTPYFDAGASCTEQEMPRYHELPTLEERSGPLHPGATSLGSPIPVPPGPPAVEDVSLDLEDEEGEEEEEYLDKINPIYDALSYSSPSDSYQGKGFVMSRAMYV

SEQ ID NO: 6 - protein, 427 aa, Homo sapiens
MEWPARLCGLWALLLCAGGGGGGGGAAPTETQPPVTNLSVSVENLCTVIWTWNPPEGASSNCSLWYFSHFGDKQDKKIAPETRRSIEVPLNERICLQVGSQCSTNESEKPSILVEKCISPPEGDPESAVTELQCIWHNLSYMKCSWLPGRNTSPDTNYTLYYWHRSLEKIHQCENIFREGQYFGCSFDLTKVKDSSFEQHSVQIMVKDNAGKIKPSFNIVPLTSRVKPDPPHIKNLSFHNDDLYVQWENPQNFISRCLFYEVEVNNSQTETHNVFYVQEAKCENPEFERNVENTSCFMVPGVLPDTLNTVRIRVKTNKLCYEDDKLWSNWSQEMSIGKKRNSTLYITMLLIVPVIVAGAIIVLLLYLKRLKIIIFPPIPDPGKIFKEMFGDQNDDTLHWKKYDIYEKQTKEETDSVVLIENLKKASQ

SEQ ID NO: 7 - protein, 461 aa, Homo sapiens
MAPVAVWAALAVGLELWAAAHALPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDFALPVGLIVGVTALGLLIIGVVNCVIMTQVKKKPLCLQREAKVPHLPADKARGTQGPEQQHLLITAPSSSSSSLESSASALDRRAPTRNQPQAPGVEASGAGEARASTGSSDSSPGGHGTQVNVTCIVNVCSSSDHSSQCSSQASSTMGDTDSSPSESPKDEQVPFSKEECAFRSQLETPETLLGSTEEKPLPLGVPDAGMKPS

SEQ ID NO: 8 - protein, 569 aa, Homo sapiens
MKVLLRLICFIALLISSLEADKCKEREEKIILVSSANEIDVRPCPLNPNEHKGTITWYKDDSKTPVSTEQASRIHQHKEKLWFVPAKVEDSGHYYCVVRNSSYCLRIKISAKFVENEPNLCYNAQAIFKQKLPVAGDGGLVCPYMEFFKNENNELPKLQWYKDCKPLLLDNIHFSGVKDRLIVMNVAEKHRGNYTCHASYTYLGKQYPITRVIEFITLEENKPTRPVIVSPANETMEVDLGSQIQLICNVTGQLSDIAYWKWNGSVIDEDDPVLGEDYYSVENPANKRRSTLITVLNISEIESRFYKHPFTCFAKNTHGIDAAYIQLIYPVTNFQKHMIGICVTLTVIIVCSVFIYKIFKIDIVLWYRDSCYDFLPIKASDGKTYDAYILYPKTVGEGSTSDCDIFVFKVLPEVLEKQCGYKLFIYGRDDYVGEDIVEVINENVKKSRRLIIILVRETSGFSWLGGSSEEQIAMYNALVQDGIKVVLLELEKIQDYEKMPESIKFIKQKHGAIRWSGDFTQGPQSAKTRFWKNVRYHMPVQRRSPSSKHQLLSPATKEKLQREAHVPLG

SEQ ID NO: 9 - protein, 532 aa, Homo sapiens
MAPSSPRPALPALLVLLGALFPGPGNAQTSVSPSKVILPRGGSVLVTCSTSCDQPKLLGIETPLPKKELLLPGNNRKVYELSNVQEDSQPMCYSNCPDGQSTAKTFLTVYWTPERVELAPLPSWQPVGKNLTLRCQVEGGAPRANLTVVLLRGEKELKREPAVGEPAEVTTTVLVRRDHHGANFSCRTELDLRPQGLELFENTSAPYQLQTFVLPATPPQLVSPRVLEVDTQGTVVCSLDGLFPVSEAQVHLALGDQRLNPTVTYGNDSFSAKASVSVTAEDEGTQRLTCAVILGNQSQETLQTVTIYSFPAPNVILTKPEVSEGTEVTVKCEAHPRAKVTLNGVPAQPLGPRAQLLLKATPEDNGRSFSCSATLEVAGQLIHKNQTRELRVLYGPRLDERDCPGNWTWPENSQQTPMCQAWGNPLPELKCLKDGTFPLPIGESVTVTRDLEGTYLCRARSTQGEVTRKVTVNVLSPRYEIVIITVVAAAVIMGTAGLSTYLYNRQRKIKKYRLQQAQKGTPMKPNTQATPP

SEQ ID NO: 10 - protein, 1163 aa, Homo sapiens
MTRTRAALLLFTALATSLGFNLDTEELTAFRVDSAGFGDSVVQYANSWVVVGAPQKITAANQTGGLYQCGYSTGACEPIGLQVPPEAVNMSLGLSLASTTSPSQLLACGPTVHHECGRNMYLTGLCFLLGPTQLTQRLPVSRQECPRQEQDIVFLIDGSGSISSRNFATMMNFVRAVISQFQRPSTQFSLMQFSNKFQTHFTFEEFRRSSNPLSLLASVHQLQGFTYTATAIQNVVHRLFHASYGARRDAAKILIVITDGKKEGDSLDYKDVIPMADAAGIIRYAIGVGLAFQNRNSWKELNDIASKPSQEHIFKVEDFDALKDIQNQLKEKIFAIEGTETTSSSSFELEMAQEGFSAVFTPDGPVLGAVGSFTWSGGAFLYPPNMSPTFINMSQENVDMRDSYLGYSTELALWKGVQSLVLGAPRYQHTGKAVIFTQVSRQWRMKAEVTGTQIGSYFGASLCSVDVDSDGSTDLVLIGAPHYYEQTRGGQVSVCPLPRGWRRWWCDAVLYGEQGHPWGRFGAALTVLGDVNGDKLTDVVIGAPGEEENRGAVYLFHGVLGPSISPSHSQRIAGSQLSSRLQYFGQALSGGQDLTQDGLVDLAVGARGQVLLLRTRPVLWVGVSMQFIPAEIPRSAFECREQVVSEQTLVQSNICLYIDKRSKNLLGSRDLQSSVTLDLALDPGRLSPRATFQETKNRSLSRVRVLGLKAHCENFNLLLPSCVEDSVTPITLRLNFTLVGKPLLAFRNLRPMLAADAQRYFTASLPFEKNCGADHICQDNLGISFSFPGLKSLLVGSNLELNAEVMVWNDGEDSYGTTITFSHPAGLSYRYVAEGQKQGQLRSLHLTCDSAPVGSQGTWSTSCRINHLIFRGGAQITFLATFDVSPKAVLGDRLLLTANVSSENNTPRTSKTTFQLELPVKYAVYTVVSSHEQFTKYLNFSESEEKESHVAMHRYQVNNLGQRDLPVSINFWVPVELNQEAVWMDVEVSHPQNPSLRCSSEKIAPPASDFLAHIQKNPVLDCSIAGCLRFRCDVPSFSVQEELDFTLKGNLSFGWVRQILQKKVSVVSVAEITFDTSVYSQLPGQEAFMRAQTTTVLEKYKVHNPTPLIVGSSIGGLLLLALITAVLYKVGFFKRQYKEMMEEANGQIAPENGTQTPSPPSEK

SEQ ID NO: 11 - protein, 351 aa, Homo sapiens
METNFSTPLNEYEEVSYESAGYTVLRILPLVVLGVTFVLGVLGNGLVIWVAGFRMTRTVTTICYLNLALADFSFTATLPFLIVSMAMGEKWPFGWFLCKLIHIVVDINLFGSVFLIGFIALDRCICVLHPVWAQNHRTVSLAMKVIVGPWILALVLTLPVFLFLTTVTIPNGDTYCTFNFASWGGTPEERLKVAITMLTARGIIRFVIGFSLPMSIVAICYGLIAAKIHKKGMIKSSRPLRVLTAVVASFFICWFPFQLVALLGTVWLKEMLFYGKYKIIDILVNPTSSLAFFNSCLNPMLYVFVGQDFRERLIHSLPTSLERALSEDSAPTNDTAANSASPPAETELQAM

SEQ ID NO: 12 - protein, 317 aa, Homo sapiens
MTMETQMSQNVCPRNLWLLQPLTVLLLLASADSQAAAPPKAVLKLEPPWINVLQEDSVTLTCQGARSPESDSIQWFHNGNLIPTHTQPSYRFKANNNDSGEYTCQTGQTSLSDPVHLTVLSEWLVLQTPHLEFQEGETIMLRCHSWKDKPLVKVTFFQNGKSQKFSHLDPTFSIPQANHSHSGDYHCTGNIGYTLFSSKPVTITVQVPSMGSSSPMGIIVAVVIATAVAAIVAAVVALIYCRKKRISANSTDPVKAAQFEPPGRQMIAIRKRQLEETNNDYETADGGYMTLNPRAPTDDDKNIYLTLPPNDHVNSNN

SEQ ID NO: 13 - protein, 290 aa, Homo sapiens
MGILSFLPVLATESDWADCKSPQPWGHMLLWTAVLFLAPVAGTPAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISANPTNPDEADKVGAENTITYSLLMHPDALEEPDDQNRI

SEQ ID NO: 14 - DNA, 1479 bp, Homo sapiens
gtcaggttcatggttacgaagctgctgaccccaggatcccagcccgtgggagagaagggggtctctgacagcccccacccctccccactgccagatccttattgggtctgagtttcaggggtggggccccagctggaggttataaaacagctcaatcggggagtacaaccttcggtttctcttcggggaaagctgctttcagcgcacacgggaagatatcagaaacatcctaggatcaggacaccccagatcttctcaactggaaccacgaaggctgtttcttccacacagtactttgatctccatttaagcaggcacctctgtcctgcgttccggagctgcgttcccgatggtcctcctttggctcacgctgctcctgatcgccctgccctgtctcctgcaaacgaaggaaggtgggaagccttgggcaggtgcggagaatctgacctgctggattcatgacgtggatttcttgagctgcagctgggcggtaggcccgggggcccccgcggacgtccagtacgacctgtacttgaacgttgccaacaggcgtcaacagtacgagtgtcttcactacaaaacggatgctcagggaacacgtatcgggtgtcgtttcgatgacatctctcgactctccagcggttctcaaagttcccacatcctggtgcggggcaggagcgcagccttcggtatcccctgcacagataagtttgtcgtcttttcacagattgagatattaactccacccaacatgactgcaaagtgtaataagacacattcctttatgcactggaaaatgagaagtcatttcaatcgcaaatttcgctatgagcttcagatacaaaagagaatgcagcctgtaatcacagaacaggtcagagacagaacctccttccagctactcaatcctggaacgtacacagtacaaataagagcccgggaaagagtgtatgaattcttgagcgcctggagcaccccccagcgcttcgagtgcgaccaggaggagggcgcaaacacacgtgcctggcggacgtcgctgctgatcgcgctggggacgctgctggccctggtctgtgtcttcgtgatctgcagaaggtatctggtgatgcagagactctttccccgcatccctcacatgaaagaccccatcggtgacagcttccaaaacgacaagctggtggtctgggaggcgggcaaagccggcctggaggagtgtctggtgactgaagtacaggtcgtgcagaaaacttgagactggggttcagggcttgtgggggtctgcctcaatctccctggccgggccaggcgcctgcacagactggctgctggacctgcgcacgcagcccaggaatggacattcctaacgggtggtgggcatgggagatgcctgtgtaatttcgtccgaagctgccaggaagaagaacagaactttgtgtgtttatttcatgataaagtgatttttttttttttaacccaaaa

SEQ ID NO: 15 - DNA, 1455 bp, Homo sapiens
gccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaacgctcactctggggaagctggttgccatgtaaaagtactactgccctgagaccaccatgctgtgaggaagcccaagctactcatgtataaatgccatgtggagatagagccccagatgtttcagccatctcagcccaggcaccagacaagtgggtgaagaagccaccttggacatgtagccccagcagatgtgatatagagaagaaacaggaaacttggctatattagtttcctagggctgcctgtgataaattattacaaactttataaactaacacattgtgtgcctatatcaaaacatcatggaaggacaggcacagtggctcatgcctgtagtcctagcactttgggagggtgagaaaggaagatctcttgagctcaggagttcaagatcagcctgggcaacacagtgagacctcatctccactaaaaataaaaaaaaattggctggaaaaaaaaaaaaaaaaaaaaaa

SEQ ID NO: 16 - DNA, 2618 bp, Homo sapiens
tccacccaagagcaacctggaactaagttattcggcaacgaactgttccactttgttgtgaggcaatagatgtggaaattccctgacgaggggctctgtcctcatacttcctgcggagcttattgtcgtaagaatatctgtcatcctgctaatgtgcattgaaaggagagcaacggggctgaggccgtgtcagcacgatggaccccaaacagaccaccctcctgtgtcttgtgctctgtctgggccagaggattcaggcacaggaaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacaggttccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggagccaggactgtggagtccgacaaagctacttgaaggacacaagagagaaaagctcactaagaagcttgaatctacttttttttttttttgagacagagtctggctctgtcacccaggctggagtgcagtggagcaatctcggctcattgaacctcttgggttcaagtgattcttgtgcctcagcctcccaagtagctggaattacaggcacataccactgcacccagctaatttttgtatttttagtagagatggggtttcactgtgttggccaggctggtctcgaactcctgacctcaggtgatccacccaccttggcctcccaaagtgctgagattataggcatgagccaccacgcctggccagatgcatgttcaaaccaatcaaatggtgttttcttatgcaggactgatcgatttgcacccacctttctgcacataagttatggttttccatcttatctgtcttctgattttttatatcctgtttaatttcttccttcattgttcttctctttttttatttattttatttatttttatttttatttttatttgagacagagtctcactctgttgcccaggctggagtgcagtggcacgatctcggctcactgcaacctctgcctcctgggttcaagtgattctcctgcctcggcctcccaagtagctgggattgcaggctcccaccatcacgcccagctacttttacagtatttttagtagagacggggtttcatcacattggccaagctggtctcaaacttctgacctcgtgatctgcccgcctcggcctcccaaagtgctgggattacagatgtgagccactgcgcccagccttctttttatatttttaaatgtgtcttccccaaatataaatggttggtaagcatgccaaatatattcaataacccccctcctttatttttttttgttgaagtgaggctctccctatgttgcctaagctggtcttgaactcctggtctcaagcaatcctcctacctcagcctcctgctgtgttcatctacaaattgataagagtgaaagtcataatcctacaggaggattaccctatttatttcacaaaccctatttctaccggattttcatacaaggaatacaggcatgtgtttcacctcattaatttattttttcacttagttttgatgatattcacatatattatcaagtgtgcaaacattaaattcttgtgtacaaaactcaaatggtcttccaaataattccccattcttttttcttataaactttcacagctttacccttgacagactttactcaaggaaatctaagttggtcatatgtggctctttcactgattgctatttacttcattgtccagtagcttatgtatgaaaatataattataaaatgtaagggtcctacttccagtgaaactgaagggacttaggcccacttttatcctttactgagagcttatctctacttgataaaatttctactgtattcttggcttaactcaggtcctgtgattaaaaaaaaaatgcaaagta

SEQ ID NO: 17 - DNA, 4201 bp, Homo sapiens
tccggcccgcacccacccccaagaggggccttcagctttggggctcagaggcacgacctcctggggagggttaaaaggcagacgcccccccgccccccgcgcccccgcgccccgactccttcgccgcctccagcctctcgccagtgggaagcggggagcagccgcgcggccggagtccggaggcgaggggaggtcggccgcaacttccccggtccaccttaagaggacgatgtagccagctcgcagcgctgaccttagaaaaacaagtttgcgcaaagtggagcggggacccggcctctgggcagccccggcggcgcttccagtgccttccagccctcgcgggcggcgcagccgcggcccatggagcccgccggcccggcccccggccgcctcgggccgctgctctgcctgctgctcgccgcgtcctgcgcctggtcaggagtggcgggtgaggaggagctgcaggtgattcagcctgacaagtccgtgttggttgcagctggagagacagccactctgcgctgcactgcgacctctctgatccctgtggggcccatccagtggttcagaggagctggaccaggccgggaattaatctacaatcaaaaagaaggccacttcccccgggtaacaactgtttcagacctcacaaagagaaacaacatggacttttccatccgcatcggtaacatcaccccagcagatgccggcacctactactgtgtgaagttccggaaagggagccccgatgacgtggagtttaagtctggagcaggcactgagctgtctgtgcgcgccaaaccctctgcccccgtggtatcgggccctgcggcgagggccacacctcagcacacagtgagcttcacctgcgagtcccacggcttctcacccagagacatcaccctgaaatggttcaaaaatgggaatgagctctcagacttccagaccaacgtggaccccgtaggagagagcgtgtcctacagcatccacagcacagccaaggtggtgctgacccgcgaggacgttcactctcaagtcatctgcgaggtggcccacgtcaccttgcagggggaccctcttcgtgggactgccaacttgtctgagaccatccgagttccacccaccttggaggttactcaacagcccgtgagggcagagaaccaggtgaatgtcacctgccaggtgaggaagttctacccccagagactacagctgacctggttggagaatggaaacgtgtcccggacagaaacggcctcaaccgttacagagaacaaggatggtacctacaactggatgagctggctcctggtgaatgtatctgcccacagggatgatgtgaagctcacctgccaggtggagcatgacgggcagccagcggtcagcaaaagccatgacctgaaggtctcagcccacccgaaggagcagggctcaaataccgccgctgagaacactggatctaatgaacggaacatctatattgtggtgggtgtggtgtgcaccttgctggtggccctactgatggcggccctctacctcgtccgaatcagacagaagaaagcccagggctccacttcttctacaaggttgcatgagcccgagaagaatgccagagaaataacacaggacacaaatgatatcacatatgcagacctgaacctgcccaaggggaagaagcctgctccccaggctgcggagcccaacaaccacacggagtatgccagcattcagaccagcccgcagcccgcgtcggaggacaccctcacctatgctgacctggacatggtccacctcaaccggacccccaagcagccggcccccaagcctgagccgtccttctcagagtacgccagcgtccaggtcccgaggaagtgaatgggaccgtggtttgctctagcacccatctctacgcgctttcttgtcccacagggagccgccgtgatgagcacagccaacccagttcccggagggctggggcggtgcaggctctgggacccaggggccagggtggctcttctctccccacccctccttggctctccagcacttcctgggcagccacggccccctccccccacattgccacatacctggaggctgacgttgccaaaccagccagggaaccaacctgggaagtggccagaactgcctggggtccaagaactcttgtgcctccgtccatcaccatgtgggttttgaagaccctcgactgcctccccgatgctccgaagcctgatcttccagggtggggaggagaaaatcccacctcccctgacctccaccacctccaccaccaccaccaccaccaccaccaccactaccaccaccacccaactggggctagagtggggaagatttcccctttagatcaaactgccccttccatggaaaagctggaaaaaaactctggaacccatatccaggcttggtgaggttgctgccaacagtcctggcctcccccatccctaggctaaagagccatgagtcctggaggaggagaggacccctcccaaaggactggagacaaaaccctctgcttccttgggtccctccaagactccctggggcccaactgtgttgctccacccggacccatctctcccttctagacctgagcttgcccctccagctagcactaagcaacatctcgctgtggacgcctgtaaattactgagaaatgtgaaacgtgcaatcttgaaactgaggtgttagaaaacttgatctgtggtgttttgttttgttttttttcttaaaacaacagcaacgtgatcttggctgtctgtcatgtgttgaagtccatggttgggtcttgtgaagtctgaggtttaacagtttgttgtcctggagggattttcttacagcgaagacttgagttcctccaagtcccagaaccccaagaatgggcaagaaggatcaggtcagccactccctggagacacagccttctggctgggactgacttggccatgttctcagctgagccacgcggctggtagtgcagccttctgtgaccccgctgtggtaagtccagcctgcccagggctgctgagggctgcctcttgacagtgcagtcttatcgagacccaatgcctcagtctgctcatccgtaaagtggggatagtgaagatgacacccctccccaccacctctcataagcactttaggaacacacagagggtagggatagtggccctggccgtctatcctacccctttagtgaccgcccccatcccggctttctgagctgatccttgaagaagaaatcttccatttctgctctcaaaccctactgggatcaaactggaataaattgaagacagccagggggatggtgcagctgtgaagctcgggctgattccccctctgtcccagaaggttggccagagggtgtgacccagttaccctttaacccccacccttccagtcgggtgtgagggcctgaccgggcccagggcaagcagatgtcgcaagccctatttattcagtcttcactataactcttagagttgagacgctaatgttcatgactcctggccttgggatgcccaagggatttctggctcaggctgtaaaagtagctgagccatcctgcccattcctggaggtcctacaggtgaaactgcaggagctcagcatagacccagctctctgggggatggtcacctggtgatttcaatgatggcatccaggaattagctgagccaacagaccatgtggacagctttggccagagctcccgtgtggcatctgggagccacagtgacccagccacctggctcaggctagttccaaattccaaaagattggcttgtaaaccttcgtctccctctcttttacccagagacagcacatacgtgtgcacacgcatgcacacacacattcagtattttaaaagaatgttttcttggtgccattttcattttattttattttttaattcttggagggggaaataagggaataaggccaaggaagatgtatagctttagctttagcctggcaacctggagaatccacataccttgtgtattgaaccccaggaaaaggaagaggtcgaaccaaccctgcggaaggagcatggtttcaggagtttattttaagactgctgggaaggaaacaggccccattttgtatatagttgcaacttaaactttttggcttgcaaaatatttttgtaataaagatttctgggtaataatga

SEQ ID NO: 18 - DNA, 2869 bp, Homo sapiens
agaattctttggcaggggcgaccttagaatcctggggaggagcgagaatggaatcccggggaggaacaggggtggaatccggggggcggggtcagaacgccaggagggggcggggccggagccagggtcggcttgactcgggggagcagcgggtggatcctgtgacgtcagcgggttcgaaccgccggagctgagcgagaggccgggggtgccgagccgggcggggagagctgggccgggagagcagaacagggaggctagagcgcagcgggaaccggcccggagccggagccggagccccacaggcacctactaaaccgcccagccgatcggcccccacagagtggcccgcgggcctccggccgggcccagtcccctcccgggccctccatggcccgggccgctgccctcctgccgtcgagatcgccgccgacgccgctgctgtggccgctgctgctgctgctgctcctggaaaccggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagagacccccaacacagcaggcgcaggggccacaggcggcatcatcgggggcatcatcgccgccatcattgctactgctgtggctgccacgggcatccttatctgccggcagcagcggaaggagcagacgctgcagggggcagaggaggacgaagacctggagggacctccctcctacaagccaccgaccccaaaagcgaagctggaggcacaggagatgccctcccagctcttcactctgggggcctcggagcacagcccactcaagaccccctactttgatgctggcgcctcatgcactgagcaggaaatgcctcgataccatgagctgcccaccttggaagaacggtcaggacccttgcaccctggagccacaagcctggggtcccccatcccggtgcctccagggccacctgctgtggaagacgtttccctggatctagaggatgaggagggggaggaggaggaagagtatctggacaagatcaaccccatctatgatgctctgtcctatagcagcccctctgattcctaccagggcaaaggctttgtcatgtcccgggccatgtatgtgtgagctgccatgcgcctggcgtctcacatctcacctgttgatcccttagctttcttgccaaggatctagtgccccctgacctctggccaggccactgtcagttaacacatatgcattccatttgtgatgtctaccttggtggctccactatgacccctaacccatgagcccagagaaattcaccgtgataatggaatcctggcaaccttatctcatgaggcaggaggtggggaaggtgcttctgcacaacctctgatcccaaggactcctctcccagactgtgaccttagaccatacctctcaccccccaatgcctcgactcccccaaaatcacaaagaagaccctagacctataatttgtcttcaggtagtaaattcccaataggtctgctggagtgggcgctgagggctccctgctgctcagacctgagccctccaggcagcagggtcccacttaccccctccccaccctgttccccaaaggtgggaaagaggggattccccagcccaaggcagggttttcccagcaccctcctgtaagcagaagtctcagggtccagacccttccctgagcccccacccccaccccaattcctgcctaccaagcaagcagccccagcctagggtcagacagggtgagcctcatacagactgtgccttgatggccccagccttgggagaagaatttactgttaacctggaagactactgaatcattttacccttgcccagtggaataggacctaaacatcccccttccggggaaagtgggtcatctgaattgggggtagcaattgatactgttttgtaaactacatttcctacaaaatatgaatttatactttgaccaggaaaaaaaaaaaaa

SEQ ID NO: 19 - DNA, 4006 bp, Homo sapiens
tgccaaggctccagcccggccgggctccgaggcgagaggctgcatggagtggccggcgcggctctgcgggctgtgggcgctgctgctctgcgccggcggcgggggcgggggcgggggcgccgcgcctacggaaactcagccacctgtgacaaatttgagtgtctctgttgaaaacctctgcacagtaatatggacatggaatccacccgagggagccagctcaaattgtagtctatggtattttagtcattttggcgacaaacaagataagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtgatcctgagtctgctgtgactgagcttcaatgcatttggcacaacctgagctacatgaagtgttcttggctccctggaaggaataccagtcccgacactaactatactctctactattggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtgtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtccaagaggctaaatgtgagaatccagaatttgagagaaatgtggagaatacatcttgtttcatggtccctggtgttcttcctgatactttgaacacagtcagaataagagtcaaaacaaataagttatgctatgaggatgacaaactctggagtaattggagccaagaaatgagtataggtaagaagcgcaattccacactctacataaccatgttactcattgttccagtcatcgtcgcaggtgcaatcatagtactcctgctttacctaaaaaggctcaagattattatattccctccaattcctgatcctggcaagatttttaaagaaatgtttggagaccagaatgatgatactctgcactggaagaagtacgacatctatgagaagcaaaccaaggaggaaaccgactctgtagtgctgatagaaaacctgaagaaagcctctcagtgatggagataatttatttttaccttcactgtgaccttgagaagattcttcccattctccatttgttatctgggaacttattaaatggaaactgaaactactgcaccatttaaaaacaggcagctcataagagccacaggtctttatgttgagtcgcgcaccgaaaaactaaaaataatgggcgctttggagaagagtgtggagtcattctcattgaattataaaagccagcaggcttcaaactaggggacaaagcaaaaagtgatgatagtggtggagttaatcttatcaagagttgtgacaacttcctgagggatctatacttgctttgtgttctttgtgtcaacatgaacaaattttatttgtaggggaactcatttggggtgcaaatgctaatgtcaaacttgagtcacaaagaacatgtagaaaacaaaatggataaaatctgatatgtattgtttgggatcctattgaaccatgtttgtggctattaaaactcttttaacagtctgggctgggtccggtggctcacgcctgtaatcccagcaatttgggagtccgaggcgggcggatcactcgaggtcaggagttccagaccagcctgaccaaaatggtgaaacctcctctctactaaaactacaaaaattaactgggtgtggtggcgcgtgcctgtaatcccagctactcgggaagctgaggcaggtgaattgtttgaacctgggaggtggaggttgcagtgagcagagatcacaccactgcactctagcctgggtgacagagcaagactctgtctaaaaaacaaaacaaaacaaaacaaaacaaaaaaacctcttaatattctggagtcatcattcccttcgacagcattttcctctgctttgaaagccccagaaatcagtgttggccatgatgacaactacagaaaaaccagaggcagcttctttgccaagacctttcaaagccattttaggctgttaggggcagtggaggtagaatgactccttgggtattagagtttcaaccatgaagtctctaacaatgtattttcttcacctctgctactcaagtagcatttactgtgtctttggtttgtgctaggcccccgggtgtgaagcacagaccccttccaggggtttacagtctatttgagactcctcagttcttgccacttttttttttaatctccaccagtcatttttcagaccttttaactcctcaattccaacactgatttccccttttgcattctccctccttcccttccttgtagccttttgactttcattggaaattaggatgtaaatctgctcaggagacctggaggagcagaggataattagcatctcaggttaagtgtgagtaatctgagaaacaatgactaattcttgcatattttgtaacttccatgtgagggttttcagcattgatatttgtgcattttctaaacagagatgaggtggtatcttcacgtagaacattggtattcgcttgagaaaaaaagaatagttgaacctatttctctttctttacaagatgggtccaggattcctcttttctctgccataaatgattaattaaatagcttttgtgtcttacattggtagccagccagccaaggctctgtttatgcttttggggggcatatattgggttccattctcacctatccacacaacatatccgtatatatcccctctactcttacttcccccaaatttaaagaagtatgggaaatgagaggcatttcccccaccccatttctctcctcacacacagactcatattactggtaggaacttgagaactttatttccaagttgttcaaacatttaccaatcatattaatacaatgatgctatttgcaattcctgctcctaggggaggggagataagaaaccctcactctctacaggtttgggtacaagtggcaacctgcttccatggccgtgtagaagcatggtgccctggcttctctgaggaagctggggttcatgacaatggcagatgtaaagttattcttgaagtcagattgaggctgggagacagccgtagtagatgttctactttgttctgctgttctctagaaagaatatttggttttcctgtataggaatgagattaattcctttccaggtattttataattctgggaagcaaaacccatgcctccccctagccatttttactgttatcctatttagatggccatgaagaggatgctgtgaaattcccaacaaacattgatgctgacagtcatgcagtctgggagtggggaagtgatcttttgttcccatcctcttcttttagcagtaaaatagctgagggaaaagggagggaaaaggaagttatgggaatacctgtggtggttgtgatccctaggtcttgggagctcttggaggtgtctgtatcagtggatttcccatcccctgtgggaaattagtaggctcatttactgttttaggtctagcctatgtggattttttcctaacatacctaagcaaacccagtgtcaggatggtaattcttattctttcgttcagttaagtttttcccttcatctgggcactgaagggatatgtgaaacaatgttaacatttttggtagtcttcaaccagggattgtttctgtttaacttcttataggaaagcttgagtaaaataaatattgtctttttgtatgtca

SEQ ID NO: 20 - DNA, 3682 bp, Homo sapiens
gcgagcgcagcggagcctggagagaaggcgctgggctgcgagggcgcgagggcgcgagggcagggggcaaccggaccccgcccgcacccatggcgcccgtcgccgtctgggccgcgctggccgtcggactggagctctgggctgcggcgcacgccttgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacttcgctcttccagttggactgattgtgggtgtgacagccttgggtctactaataataggagtggtgaactgtgtcatcatgacccaggtgaaaaagaagcccttgtgcctgcagagagaagccaaggtgcctcacttgcctgccgataaggcccggggtacacagggccccgagcagcagcacctgctgatcacagcgccgagctccagcagcagctccctggagagctcggccagtgcgttggacagaagggcgcccactcggaaccagccacaggcaccaggcgtggaggccagtggggccggggaggcccgggccagcaccgggagctcagattcttcccctggtggccatgggacccaggtcaatgtcacctgcatcgtgaacgtctgtagcagctctgaccacagctcacagtgctcctcccaagccagctccacaatgggagacacagattccagcccctcggagtccccgaaggacgagcaggtccccttctccaaggaggaatgtgcctttcggtcacagctggagacgccagagaccctgctggggagcaccgaagagaagcccctgccccttggagtgcctgatgctgggatgaagcccagttaaccaggccggtgtgggctgtgtcgtagccaaggtgggctgagccctggcaggatgaccctgcgaaggggccctggtccttccaggcccccaccactaggactctgaggctctttctgggccaagttcctctagtgccctccacagccgcagcctccctctgacctgcaggccaagagcagaggcagcgagttgtggaaagcctctgctgccatggcgtgtccctctcggaaggctggctgggcatggacgttcggggcatgctggggcaagtccctgactctctgtgacctgccccgcccagctgcacctgccagcctggcttctggagcccttgggttttttgtttgtttgtttgtttgtttgtttgtttctccccctgggctctgccccagctctggcttccagaaaaccccagcatccttttctgcagaggggctttctggagaggagggatgctgcctgagtcacccatgaagacaggacagtgcttcagcctgaggctgagactgcgggatggtcctggggctctgtgcagggaggaggtggcagccctgtagggaacggggtccttcaagttagctcaggaggcttggaaagcatcacctcaggccaggtgcagtggctcacgcctatgatcccagcactttgggaggctgaggcgggtggatcacctgaggttaggagttcgagaccagcctggccaacatggtaaaaccccatctctactaaaaatacagaaattagccgggcgtggtggcgggcacctatagtcccagctactcagaagcctgaggctgggaaatcgtttgaacccgggaagcggaggttgcagggagccgagatcacgccactgcactccagcctgggcgacagagcgagagtctgtctcaaaagaaaaaaaaaagcaccgcctccaaatgccaacttgtccttttgtaccatggtgtgaaagtcagatgcccagagggcccaggcaggccaccatattcagtgctgtggcctgggcaagataacgcacttctaactagaaatctgccaattttttaaaaaagtaagtaccactcaggccaacaagccaacgacaaagccaaactctgccagccacatccaaccccccacctgccatttgcaccctccgccttcactccggtgtgcctgcagccccgcgcctccttccttgctgtcctaggccacaccatctcctttcagggaatttcaggaactagagatgactgagtcctcgtagccatctctctactcctacctcagcctagaccctcctcctcccccagaggggtgggttcctcttccccactccccaccttcaattcctgggccccaaacgggctgccctgccactttggtacatggccagtgtgatcccaagtgccagtcttgtgtctgcgtctgtgttgcgtgtcgtgggtgtgtgtagccaaggtcggtaagttgaatggcctgccttgaagccactgaagctgggattcctccccattagagtcagccttccccctcccagggccagggccctgcagaggggaaaccagtgtagccttgcccggattctgggaggaagcaggttgaggggctcctggaaaggctcagtctcaggagcatggggataaaggagaaggcatgaaattgtctagcagagcaggggcagggtgataaattgttgataaattccactggacttgagcttggcagctgaactattggagggtgggagagcccagccattaccatggagacaagaagggttttccaccctggaatcaagatgtcagactggctggctgcagtgacgtgcacctgtactcaggaggctgaggggaggatcactggagcccaggagtttgaggctgcagcgagctatgatcgcgccactacactccagcctgagcaacagagtgagaccctgtctcttaaagaaaaaaaaagtcagactgctgggactggccaggtttctgcccacattggacccacatgaggacatgatggagcgcacctgccccctggtggacagtcctgggagaacctcaggcttccttggcatcacagggcagagccgggaagcgatgaatttggagactctgtggggccttggttcccttgtgtgtgtgtgttgatcccaagacaatgaaagtttgcactgtatgctggacggcattcctgcttatcaataaacctgtttgttttaaaaaaaa

SEQ ID NO: 21 - DNA, 5170 bp, Homo sapiens
gtggccggcggccggagccgactcggagcgcgcggcgccggccgggaggagccggagagcggccgggccgggcggtgggggcgccggcctgccccgcgcgccccagggagcggcaggaatgtgacaatcgcgcgcccgcgcaccgaagcactcctcgctcggctcctagggctctcgcccctctgagctgagccgggttccgcccggggctgggatcccatcaccctccacggccgtccgtccaggtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctagaggaaaacaaacccacaaggcctgtgattgtgagcccagctaatgagacaatggaagtagacttgggatcccagatacaattgatctgtaatgtcaccggccagttgagtgacattgcttactggaagtggaatgggtcagtaattgatgaagatgacccagtgctaggggaagactattacagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccagtcactaatttccagaagcacatgattggtatatgtgtcacgttgacagtcataattgtgtgttctgttttcatctataaaatcttcaagattgacattgtgctttggtacagggattcctgctatgattttctcccaataaaagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcatggagaagttgccaagagttctttaggtgcctcctgtcttatggcgttgcaggccaggttatgcctcatgctgacttgcagagttcatggaatgtaactatatcatcctttatccctgaggtcacctggaatcagattattaagggaataagccatgacgtcaatagcagcccagggcacttcagagtagagggcttgggaagatcttttaaaaaggcagtaggcccggtgtggtggctcacgcctataatcccagcactttgggaggctgaagtgggtggatcaccagaggtcaggagttcgagaccagcccagccaacatggcaaaaccccatctctactaaaaatacaaaaatgagctaggcatggtggcacacgcctgtaatcccagctacacctgaggctgaggcaggagaattgcttgaaccggggagacggaggttgcagtgagccgagtttgggccactgcactctagcctggcaacagagcaagactccgtctcaaaaaaagggcaataaatgccctctctgaatgtttgaactgccaagaaaaggcatggagacagcgaactagaagaaagggcaagaaggaaatagccaccgtctacagatggcttagttaagtcatccacagcccaagggcggggctatgccttgtctggggaccctgtagagtcactgaccctggagcggctctcctgagaggtgctgcaggcaaagtgagactgacacctcactgaggaagggagacatattcttggagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctggcatgaccatcctgtcctttgttattatcctgcattttacgtctttggaggaacagctccctagtggcttcctccgtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctcttgcctgcacccttcctcctcctttgcctaggaggccttctcgcattttctctagctgatcagaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacatagatttatgtaatgctttatgtttaaaaacattccccaattatcttatttaatttttgcaattattctaattttatatatagagaaagtgacctattttttaaaaaaatcacactctaagttctattgaacctaggacttgagcctccatttctggcttctagtctggtgttctgagtacttgatttcaggtcaataacggtcccccctcactccacactggcacgtttgtgagaagaaatgacattttgctaggaagtgaccgagtctaggaatgcttttattcaagacaccaaattccaaacttctaaatgttggaattttcaaaaattgtgtttagattttatgaaaaactcttctactttcatctattctttccctagaggcaaacatttcttaaaatgtttcattttcattaaaaatgaaagccaaatttatatgccaccgattgcaggacacaagcacagttttaagagttgtatgaacatggagaggacttttggtttttatatttctcgtatttaatatgggtgaacaccaacttttatttggaataataattttcctcctaaacaaaaacacattgagtttaagtctctgactcttgcctttccacctgctttctcctgggcccgctttgcctgcttgaaggaacagtgctgttctggagctgctgttccaacagacagggcctagctttcatttgacacacagactacagccagaagcccatggagcagggatgtcacgtcttgaaaagcctattagatgttttacaaatttaattttgcagattattttagtctgtcatccagaaaatgtgtcagcatgcatagtgctaagaaagcaagccaatttggaaacttaggttagtgacaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcatttttttaaagatgccctaagtgttgaagaagagtttgcaaatgcaacaaaatatttaattaccggttgttaaaactggtttagcacaatttatattttccctctcttgcctttcttatttgcaataaaaggtattgagccattttttaaatgacatttttgataaattatgtttgtactagttgatgaaggagttttttttaacctgtttatataattttgcagcagaagccaaattttttgtatattaaagcaccaaattcatgtacagcatgcatcacggatcaatagactgtacttattttccaataaaattttcaaactttgtactgttaaaaaaaaaaaaaaaaaa

SEQ ID NO: 22 - DNA, 3249 bp, Homo sapiens
caagcttagcctggccgggaaacgggaggcgtggaggccgggagcagcccccggggtcatcgccctgccaccgccgcccgattgctttagcttggaaattccggagctgaagcggccagcgagggaggatgaccctctcggcccgggcaccctgtcagtccggaaataactgcagcatttgttccggaggggaaggcgcgaggtttccgggaaagcagcaccgccccttggcccccaggtggctagcgctataaaggatcacgcgccccagtcgacgctgagctcctctgctactcagagttgcaacctcagcctcgctatggctcccagcagcccccggcccgcgctgcccgcactcctggtcctgctcggggctctgttcccaggacctggcaatgcccagacatctgtgtccccctcaaaagtcatcctgccccggggaggctccgtgctggtgacatgcagcacctcctgtgaccagcccaagttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttgtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcaaggtgaccgtgaatgtgctctccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggccccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctaatcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgattttttttttttttccagagacggggtctcgcaacattgcccagacttcctttgtgttagttaataaagctttctcaactgccaaa

SEQ ID NO: 23 - DNA, 4720 bp, Homo sapiens
atgctgacaatcttcttccttcccctggccacctctctgcccacttgcttcctcagtaccttggtccagctcttcctgcaacggcccaggagctcagagctccacatctgaccttctagtcatgaccaggaccagggcagcactcctcctgttcacagccttagcaacttctctaggtttcaacttggacacagaggagctgacagccttccgtgtggacagcgctgggtttggagacagcgtggtccagtatgccaactcctgggtggtggttggagccccccaaaagataacagctgccaaccaaacgggtggcctctaccagtgtggctacagcactggtgcctgtgagcccatcggcctgcaggtgcccccggaggccgtgaacatgtccctgggcctgtccctggcgtctaccaccagcccttcccagctgctggcctgcggccccaccgtgcaccacgagtgcgggaggaacatgtacctcaccggactctgcttcctcctgggccccacccagctcacccagaggctcccggtgtccaggcaggagtgcccaagacaggagcaggacattgtgttcctgatcgatggctcaggcagcatctcctcccgcaactttgccacgatgatgaacttcgtgagagctgtgataagccagttccagagacccagcacccagttttccctgatgcagttctccaacaaattccaaacacacttcactttcgaggaattcaggcgcagctcaaaccccctcagcctgttggcttctgttcaccagctgcaagggtttacatacacggccaccgccatccaaaatgtcgtgcaccgattgttccatgcctcatatggggcccgtagggatgccgccaaaattctcattgtcatcactgatgggaagaaagaaggcgacagcctggattataaggatgtcatccccatggctgatgcagcaggcatcatccgctatgcaattggggttggattagcttttcaaaacagaaattcttggaaagaattaaatgacattgcatcgaagccctcccaggaacacatatttaaagtggaggactttgatgctctgaaagatattcaaaaccaactgaaggagaagatctttgccattgagggtacggagaccacaagcagtagctccttcgaattggagatggcacaggagggcttcagcgctgtgttcacacctgatggccccgttctgggggctgtggggagcttcacctggtctggaggtgccttcctgtaccccccaaatatgagccctaccttcatcaacatgtctcaggagaatgtggacatgagggactcttacctgggttactccaccgagctggccctctggaaaggggtgcagagcctggtcctgggggccccccgctaccagcacaccgggaaggctgtcatcttcacccaggtgtccaggcaatggaggatgaaggccgaagtcacggggactcagatcggctcctacttcggggcctccctctgctccgtggacgtagacagcgacggcagcaccgacctggtcctcatcggggccccccattactacgagcagacccgagggggccaggtgtctgtgtgtcccttgcccagggggtggagaaggtggtggtgtgatgctgttctctacggggagcagggccacccctggggtcgctttggggcggctctgacagtgctgggggatgtgaatggggacaagctgacagacgtggtcatcggggccccaggagaggaggagaaccggggtgctgtctacctgtttcacggagtcttgggacccagcatcagcccctcccacagccagcggatcgcgggctcccagctctcctccaggctgcagtattttgggcaggcactgagcgggggtcaagacctcacccaggatggactggtggacctggctgtgggggcccggggccaggtgctcctgctcaggaccagacctgtgctctgggtgggggtgagcatgcagttcatacctgccgagatccccaggtctgcgtttgagtgtcgggagcaggtggtctctgagcagaccctggtacagtccaacatctgcctttacattgacaaacgttctaagaacctgcttgggagccgtgacctccaaagctctgtgaccttggacctggccctcgaccctggccgcctgagtccccgtgccaccttccaggaaacaaagaaccggagtctgagccgagtccgagtcctcgggctgaaggcacactgtgaaaacttcaacctgctgctcccgagctgcgtggaggactctgtgacccccattaccttgcgtctgaacttcacgctggtgggcaagcccctccttgccttcagaaacctgcggcctatgctggccgccgatgctcagagatacttcacggcctccctaccctttgagaagaactgtggagccgaccatatctgccaggacaatctcggcatctccttcagcttcccaggcttgaagtccctgctggtggggagtaacctggagctgaacgcagaagtgatggtgtggaatgacggggaagactcctacggaaccaccatcaccttctcccaccccgcaggactgtcctaccgctacgtggcagagggccagaaacaagggcagctgcgttccctgcacctgacatgtgacagcgccccagttgggagccagggcacctggagcaccagctgcagaatcaaccacctcatcttccgtggcggcgcccagatcaccttcttggctacctttgacgtctcccccaaggctgtcctgggagaccggctgcttctgacagccaatgtgagcagtgagaacaacactcccaggaccagcaagaccaccttccagctggagctcccggtgaagtatgctgtctacactgtggttagcagccacgaacaattcaccaaatacctcaacttctcagagtctgaggagaaggaaagccatgtggccatgcacagataccaggtcaataacctgggacagagggacctgcctgtcagcatcaacttctgggtgcctgtggagctgaaccaggaggctgtgtggatggatgtggaggtctcccacccccagaacccatcccttcggtgctcctcagagaaaatcgcacccccagcatctgacttcctggcgcacattcagaagaatcccgtgctggactgctccattgctggctgcctgcggttccgctgtgacgtcccctccttcagcgtccaggaggagctggatttcaccctgaagggcaacctcagctttggctgggtccgccagatattgcagaagaaggtgtcggtcgtgagtgtggctgaaattacgttcgacacatccgtgtactcccagcttccaggacaggaggcatttatgagagctcagacgacaacggtgctggagaagtacaaggtccacaaccccacccccctcatcgtaggcagctccattgggggtctgttgctgctggcactcatcacagcggtactgtacaaagttggcttcttcaagcgtcagtacaaggaaatgatggaggaggcaaatggacaaattgccccagaaaacgggacacagacccccagcccgcccagtgagaaatgatcccctctttgccttggacttcttctcccccgcgagttttccccacttacttaccctcacctgtcaggcctgacggggaggaaccactgcaccaccgagagaggctgggatgggcctgcttcctgtctttgggagaaaacgtcttgcttgggaaggggcctttgtcttgtcaaggttccaactggaaacccttaggacagggtccctgctgtgttccccaaaggacttgacttgcaatttctacctagaaatacatggacaatacccccaggcctcagtctcccttctcccatgaggcacgaatgatctttctttcctttctttttttttttttttcttttcttttttttttttttgagacggagtctcgctctgtcacccaggctggagtgcaatggcgtgatctcggctcactgcaacctccgcctcccgggttcaagtaattctgctgtctcagcctcctgagtagctgggactacaggcacacgccacctcgcccggcccgatctttctaaaatacagttctgaatatgctgctcatccccacctgtcttcaacagctccccattaccctcaggacaatgtctgaactctccagcttcgcgtgagaagtccccttccatcccagagggtgggcttcagggcgcacagcatgagaggctctgtgcccccatcaccctcgtttccagtgaattagtgtcatgtcagcatcagctcagggcttcatcgtggggctctcagttccgatttcccaggctgaattgggagtgagatgcctgcatgctgggttctgcacagctggcctcccgcgttgggcaacattgctggctggaagggaggagcgccctctagggagggacatggccccggtgcggctgcagctcacccagccccaggggcagaagagacccaaccacttctattttttgaggctatgaatatagtacctgaaaaaatgccaagacatgattatttttttaaaaagcgtactttaaatgtttgtgttaataaattaaaacatgcacaaaaagatgcatctaccgctcttgggaaatatgtcaaaggtctaaaaataaaaaagccttctgtgaaaaaaaaaaaaaaaaa

SEQ ID NO: 24 - DNA, 1921 bp, Homo sapiens
gaagcacacaggaaaaggagcttagctgctggtgctgctggcaagatggaaaccaacttctccactcctctgaatgaatatgaagaagtgtcctatgagtctgctggctacactgttctgcggatcctcccattggtggtgcttggggtcacctttgtcctcggggtcctgggcaatgggcttgtgatctgggtggctggattccggatgacacgcacagtcaccaccatctgttacctgaacctggccctggctgacttttctttcacggccacattaccattcctcattgtctccatggccatgggagaaaaatggccttttggctggttcctgtgtaagttaattcacatcgtggtggacatcaacctctttggaagtgtcttcttgattggtttcattgcactggaccgctgcatttgtgtcctgcatccagtctgggcccagaaccaccgcactgtgagtctggccatgaaggtgatcgtcggaccttggattcttgctctagtccttaccttgccagttttcctctttttgactacagtaactattccaaatggggacacatactgtactttcaactttgcatcctggggtggcacccctgaggagaggctgaaggtggccattaccatgctgacagccagagggattatccggtttgtcattggctttagcttgccgatgtccattgttgccatctgctatgggctcattgcagccaagatccacaaaaagggcatgattaaatccagccgtcccttacgggtcctcactgctgtggtggcttctttcttcatctgttggtttccctttcaactggttgcccttctgggcaccgtctggctcaaagagatgttgttctatggcaagtacaaaatcattgacatcctggttaacccaacgagctccctggccttcttcaacagctgcctcaaccccatgctttacgtctttgtgggccaagacttccgagagagactgatccactccctgcccaccagtctggagagggccctgtctgaggactcagccccaactaatgacacggctgccaattctgcttcacctcctgcagagactgagttacaggcaatgtgaggatggggtcagggatattttgagttctgttcatcctaccctaatgccagttccagcttcatctacccttgagtcatattgaggcattcaaggatgcacagctcaagtatttattcaggaaaaatgcttttgtgtccctgatttggggctaagaaatagacagtcaggctactaaaatattagtgttattttttgttttttgacttctgcctataccctggggtaagtggagttgggaaatacaagaagagaaagaccagtggggatttgtaagacttagatgagatagcgcataataaggggaagactttaaagtataaagtaaaatgtttgctgtaggttttttatagctattaaaaaaaatcagattatggaagttttcttctatttttagtttgctaagagttttctgtttctttttcttacatcatgagtggactttgcattttatcaaatgcattttctacatgtattaagatggtcatattattcttcttcttttatgtaaatcattataaataatgttcattaagttctgaatgttaaactactcttgaattcctggaataaaccacacttagtcctgatgtactttaaatatttatatctcacaggagttggttagaatttctgtgtttatgtttatatactgttatttcactttttctactatccttgctaagttttcatagaaaataaggaacaaagagaaacttgtaatggtctctgaaaaggaattgagaagtaattcctctgattctgttttctggtgttatatctttattaaatattcagaaaaattcaccagtgaaaaaaaaaa

SEQ ID NO: 25 - DNA, 2429 bp, Homo sapiens
ctcttttctaagcttgtctcttaaaacccactggacgttggcacagtgctgggatgactatggagacccaaatgtctcagaatgtatgtcccagaaacctgtggctgcttcaaccattgacagttttgctgctgctggcttctgcagacagtcaagctgcagctcccccaaaggctgtgctgaaacttgagcccccgtggatcaacgtgctccaggaggactctgtgactctgacatgccagggggctcgcagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttccgaatggctggtgctccagacccctcacctggagttccaggagggagaaaccatcatgctgaggtgccacagctggaaggacaagcctctggtcaaggtcacattcttccagaatggaaaatcccagaaattctcccatttggatcccaccttctccatcccacaagcaaaccacagtcacagtggtgattaccactgcacaggaaacataggctacacgctgttctcatccaagcctgtgaccatcactgtccaagtgcccagcatgggcagctcttcaccaatggggatcattgtggctgtggtcattgcgactgctgtagcagccattgttgctgctgtagtggccttgatctactgcaggaaaaagcggatttcagccaattccactgatcctgtgaaggctgcccaatttgagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatactctcagcttgctgagtggatgacaaaaagaggggaattgttaaaggaaaatttaaatggagactggaaaaatcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtgactagggactttctaagaagatacctacccccaaaaaacaattatgtaattgaaaaccaaccgattgcctttattttgcttccacattttcccaataaatacttgcctgtgacattttgccactggaacactaaacttcatgaattgcgcctcagatttttcctttaacatcttttttttttttgacagagtctcaatctgttacccaggctggagtgcagtggtgctatcttggctcactgcaaacccgcctcccaggtttaagcgattctcatgcctcagcctcccagtagctgggattagaggcatgtgccatcatacccagctaatttttgtattttttattttttttttttagtagagacagggtttcgcaatgttggccaggccgatctcgaacttctggcctctagcgatctgcccgcctcggcctcccaaagtgctgggatgaccagcatcagccccaatgtccagcctctttaacatcttctttcctatgccctctctgtggatccctactgctggtttctgccttctccatgctgagaacaaaatcacctattcactgcttatgcagtcggaagctccagaagaacaaagagcccaattaccagaaccacattaagtctccattgttttgccttgggatttgagaagagaattagagaggtgaggatctggtatttcctggactaaattccccttggggaagacgaagggatgctgcagttccaaaagagaaggactcttccagagtcatctacctgagtcccaaagctccctgtcctgaaagccacagacaatatggtcccaaatgactgactgcaccttctgtgcctcagccgttcttgacatcaagaatcttctgttccacatccacacagccaatacaattagtcaaaccactgttattaacagatgtagcaacatgagaaacgcttatgttacaggttacatgagagcaatcatgtaagtctatatgacttcagaaatgttaaaatagactaacctctaacaacaaattaaaagtgattgtttcaaggtgatgcaattattgatgacctattttatttttctataatgatcatatattacctttgtaataaaacattataaccaaaaca

SEQ ID NO: 26 - DNA, 2114 bp, Homo sapiens
agaacatttctttttcacttcccctttcagactccagaatttgtttgccctctagggtagaatccgccaagctttgagagaaggctgtgactgctgtgctctgggcgccagctcgctccagggagtgatgggaatcctgtcattcttacctgtccttgccactgagagtgactgggctgactgcaagtccccccagccttggggtcatatgcttctgtggacagctgtgctattcctggctcctgttgctgggacacctgctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcagccaatcccactaatcctgatgaggctgacaaagttggggctgagaacacaatcacctattcacttctcatgcacccggatgctctggaagagcctgatgaccagaaccgtatttagtctccattgtcttgcattgggatttgagaagaaaatcagagagggaagatctggtatttcctggcctaaattccccttggggaggacagggagatgctgcagttccaaaagagaaggtttcttccagagtcatctacctgagtcctgaagctccctgtcctgaaagccacagacaatatggtcccaaataaccgactgcaccttctgtgcttcagctcttcttgacatcaaggctcttccgttccacatccacacagccaatccaattaatcaaaccactgttattaacagataatagcaacttgggaaatgcttatgttacaggttacgtgagaacaatcatgtaaatctatatgatttcagaaatgttaaaatagactaacctctaccagcacattaaaagtgattgtttctgggtgataaaattattgatgatttttattttctttatttttctataaagatcatatattacttttataataaaacattataaaaacaacattctgtttaccttttcaaggctgtattggttggagtgtagactgaactgcctggggtctgtttctcttcagtgatgagactcttaggaaggcaggaatggataggatagggggaggagaggagagatggggatttagaatgtagagtgagtgccccttttcttaaaactgaatacagtcacgcaccacataatgatgtttagttcaacaacagactgcatatatgatggtgatcccataaaattataataccatatttctattgtaccttttctattcctatgtttagatatatgagtacttaccattgtgttacaattgcctaaagtattcagtacagtagcatgctgtacaggtttgtagcctaggggcaataggctatacgctacagcctaggtgtgtagtaggccacaccatttaggtttgtataagtacctgctatgatgttcacacaacaaaattgcctgcatttctcaaaatgtatccccatatttcaacaatgcatgactgtactcttctgccaatgaccttgtattcttgtttccatgtcttcttctctttcctcctatggcaaataaaacactgttttgcaacacaaaaaaaaaaaaaaa

SEQ ID NO: 27 - DNA, 46115 bp, Homo sapiens
acatgataattttcaaagaaagagtctttctttcaaggaaagtcaggttcatggttacgaagctgctgaccccaggatcccagcccgtgggagagaagggggtctctgacagcccccacccctccccactgccagatccttattgggtctgagtttcaggggtggggccccagctggaggttataaaacagctcaatcggggagtacaaccttcggtttctcttcggggaaagctgctttcagcgcacacgggaagatatcagaaacatcctaggatcaggacaccccagatcttctcaactggaaccacgaaggctgtttcttccacacagtactttgatctccatttaaggtaaggtcccccctccagggtgggatgagggaaaaagagggcaggcaggggaggcggtggactgtgggttcccaaatccaagctggcagacacggggcattggcatgtaacaggtttctgctgagacctgctgtccgtgtgggcaccacaccacacatagaatgacccggtaccagagaagtatgtttgcgatctcattcacccttttgtaagtggatcggacgctgaagccatcatagcatgttagatgccttgggtttataaaggtgatagcattaggagtaatttgacagtgctttctgctttttctgtgtgcttgctagaaaatgtacacacctacacatggctagagttctctgtttattagaaagcgctggttcagttagtcaatgagctcacgcccagggcgagctgactgccagccggggagccgcttttggggctgggaccccagcctgcttgtagtgtttctcagtggttttcaaaggctggcgggactcagaatgttccagatggctggtgaaacctcaggtccctcctagcagctttattcacagtagccaagaggtggagacagccctcgtacccatctatagatgaatggaaaaatataatgtccatccacacagtggaatattacgcagccatgaaaaggaacaagcagctttattcacaatagccaagaggtggagacagccctcatacccatctatagacgaatggataaatataatgtggtccagccacacggtggaatattacacagccatgaaaaggaacaagcagctttattcacaatagccaagaggtggagacagccctcatacccatctatagacgaatggataaatataatgtggtccagccacacagtggaatattacacagccatgaaaaggaacaagcagctttattcacaatagccaagaggtggagacagccctcatacccatctatagatgaatggagaaatataatgtggtccagccacacagtggaatattatacagccatgaaaaggaacaagcagctttattcacaatagccaagaggtggagacagccctcgtacccatctatagatgaatggagaaatataatgtggtccagacacacagtggaatattatacagccatgaaaaggaacaagcagctttattcacaatagccaagaggtggagacagccctcatacccccatctatagatgaagggagaaatataatgtccatccacacagtggaatattacacagccatgaaaaggaacaagcagctttattcacaatagccaagaggtggagacagccctcatacccatctatagatgaatggaaaaatataatgtccatccacacagtggaatattacacagccatgaaaaggaacaagcagctttattcacaatagccaagaggtggagacagccctcataccccatctatagatgaatggagaaatataatgtggtccagccacacggtggaatattacacagccatgaaaaggaataagcagctttattcacactagccaagaggtggagagagtcctcatacccatctatagatgaatggagaaatataatgtggtccagccacacggtggaatattacacagccatgaaaaggaacgaggctctgccacaggtggcaatgtgggtgaatgctgaggacatcatgcttcctgagagaggccagatacaaaaagatacatagtgtctgtatgattccatttattccctatgtccagatacaggcaaatccacagagacagaaagtggatgagtggttgccacaggctggggaagaggaaggacgggtctttaatgggtctggagtctccttttggggtcgtgacaatgttctagaagatagaagtggtggttttttttgagacagagtctcgctctgtcgcccaggctggagtgcagtggcgcgatctcagctcactgcaacctccacctcccgggttcaagcaattctcctgcctcagcctcctgagtagctgggactacaggcacccgcaactacgcctggctaatttttgtatgtttagtagagactttgtatgtttagtagagtagtagagattttgtatgtttagtatgttttgtatgttggtcaggctggtctcgaactcctgacctcaagcaatccacccccctcagcctcccaaagtgctgggattataggcgtgagccaccgcgcctggccaatgaaaatattaatcaataaatgttaagagcacagatttcccaacgttctgactcaggcatcttcctggaccacagcccctacaggcaagtgtgactgtgtgtggtgagcccatgagctgaacacaggctctgtccgaaaggagactctagagattgcctgttgccttggaggtgggctgcggtccctctgcccaggcaggaaggggctccgaggcctctggaacctcattttaccttttccctgctgccctcagtcccgtccccagcctcaaggggctcagctttttccaggctcaccccttccatttataatttggagacaagcaaggtccactgacgctaacgccatttggttctttaaaagatgttaggccgggcgcggtggctcacgcctgtcatcccagcactttgggaggccaaggcgggtggatcatgaggtcaggagttcgagaccagcctgaccaacatggtgaaacaccatctctactaaaaatagaaaaattagctgggtgtggtggcggacaccggtaatcccatctactggggaggctgaggcaggagaatcgcttgaacgtgggaggtggaggttgcagtgaaccaagatcgcgccactgcactccggcctggacaacaagagtgagactccatctcagaaaaaacaaaacaaaacaaaacaaaaaaccagaaaagacagctgccaccccagagcacagtgtaggagagccagcctttctgggatgcggcagaaagttccagtgcaggaggctgaggtcctgtacccccttgttacggtaactgcagccacttaggaatttccgtgtgttgatttcatcattgtaattatacttccttccactgctttgtcatctgagcttcctggtgtgccgcagaggatgtgttttcctggtttgtggatacagctcgagccaagaacgggctaaacccccagggcagcaactctttcttttcttttcttttttttttttttttttgagacggagtctcgctctgtcgtccaggctggagtgcagtggcgccatctcggctcactgcaagctccacctcccgggttcaactgattgtcctgcctcagcctcccgagtagctgggattataggcacactccaccacgcctggctaatttttgtatttttagtagagacggggtttcaccatgttagccaggctggtcttgaactcctgacctcgggcaatctgcccacctctgcttcccaaagtgctgggattactggcatgagccactgcacccagccggcagggcttctttcaaaagggaacggctgacacacacacagatgcatgcacatacatgcacacatacacactgatgcaaacacatttgtacacatacattcacacatgcatgcacataaatatgcacttctaggcacatgcatgcacacatacagactcatgcatgtatatttgtgtatgcacatatatttatgcacatgtgtgtacacgtggaatgcatgcacagatacatatgcattcaaacacaaagactgtgtgtacctgcatgcatgaaaacacacaaacacagccgggcacggtggctcacacctgtaatctcagcacttggcgaggaaaaggcgggcggatcacctgaggcaggagtccgagaccagcctggccaacatggtcaaatctctactaaaaaatacaaaaagtgggctggacgcggtggctgacgcctgtcatcccagcactttgggaggctgaggtgggtggatcacctgaggtcaggagttcgagaccagcctggccaacacggtgaaaccccgtctctgctaaaaatacaaaaattagccggacatggtggtgggtgcctataatcccagctactcgggaggctgaggcaggacaatcggttgaacctgggaggcggaggttgcagtgagcccagatcacgccattgcactccagcctgggcaacaagagcaaaactctgtcacaaaaaataaataaataaataaataatacaaaaattagccaggcatggtggcgagtgcctgtaatcccagctactcaggaggctgaggcaggagagtcgcttgaacctgggaggcagaggttgcaatgagccgagatcatgccactgcactccagcctggacgacaagggcgagtctccatcaggaaaaaaaaaaaaagaaaacacacaaacacttatgtgtgcacacagatacacacgggcacaaaaatgtacacacgtgcaagcacacacacacacagacacatgtacacagtacccgtgtgtgcacaggcatgcatgcagtcctgcaaatgtgcaaacagacatggctacatagaggcatgcacacatatagacccatgtacacacacacgaatattcgtgcacacatgtagaagcacactctgatgtgcatgcatgtgcaaaggcgcatttgcacacagacacatatgcacactcaccaccgctttccctccagaagcagctccttctgctgtgagcaccaggctctggaaggggcaagcatccttcattacccgcaacccagtttcacagccagtccccgctgcctgactctcgtttctcctgcagcaggcacctctgtcctgcgttccggagctgcgttcccgatggtcctcctttggctcacgctgctcctgatcgccctgccctgtctcctgcaaacgaaggaaggtaagaactggagaaaaaatgcacgtgccacctggggagcggtgggggtagacagacacacaatgtcagcgtgccgtccttcagggaaacttttcatgctgagctcatggcagagtctcatgcagtggtcgggaatgactcagacacttccctgtacccgtcaccaagttccctgtaatgcagcatcttgcaaaacggtaatacgacctcacaggcagggacctgatcgtgacacagatgccatgtgaggtgttttgatgaaactcacacgctgggatcaacagcaccaataacaatttccagtttccttcattgtttatcttactttttcattttcttattatttttattttggagacagggtcttactgtcttgcccaggctggagtgcaatagtgtgatctcggctcactgcaacctctgcctcccggattcaagcgattcttctgcctcagcctcccgaggagctgagattacagtcgcgcaccaccatacccggctaatttctgtatttttgatagagacgggatttcactatgtcggtcaggctggtctagaactgctgaccacaagtgatccgtctgccttggcctcccaaagtgctgggattacaggtgtgagccacagcgcccggccttttttttcattggtttttacagtctattactgcagggtttcactttaccttgaatttcttttaactttaatttgcttttcattctttaacttcttttttttttttttttttgacacagagtttcattctggtcgcccaggctggagtgtaatagcgtgaccatggctcactgcaacctctacctgctgggttcaattgattctcctgtctcagcctcccaagcacctgggattacaggtgtccgccaccacgcccagctaatttttctgtttttactagagacggggtttcaccgtgttagacaggatggtctcgatctcctgacctcatgatccgcctgcctcggggttgggattacacactttgggaggccaaggcaggtggacgatcacaaggtcaggagttcgtgaccagcctgactaacacggtgaaaccccgtctctactaaaaatacaaaaatcagctgggcgtggtggcgggcgcctgtaatcccagttactcgggaggctgaggcaggagagtcgcttgaacccgggaggaggaggttgcagtgagcctagatcacgccattgcactccagcctgggcgacagagtgagactccgtctcaaaatgaatgaatgaatgaatgaatttcttataagaatttttttccccagacagtttgttttaagggataaattatccttctaagttagaagaaaataatgccagaagtctagacattcttatgctttggtcccgcttatcaaaccaaggttgctgaccttgataaccactcaagatccttacagtttataaagtcatttcctcaagttttctaagtggccgatcagagataaaccctagagaaatagttgatgtatgtttctagctttgggtgaccagcaaaatgtgatagaatattgccttttactggccgggtgcaacggctcacgtctgtaatcccagcactttgggaggctgaggcgggtggatcacttgaggtcaggagttcaaaaccagcttggccatcatggtgaaaccccgtctgtactaaaaatacaaaaaaattagctgggcgcggtgctgtgcacctgtaatccctgctactcaggaggctgaggcaggagaatcacttgaacccgggaggcggaggttgccgtgagccaagatcacgccattgcactccaacctgggtgacagagcgaggctccatctcaaaaaaaaaaaaaaaaaaagaatattgcctttaacatctttgtacaggtcatttatgaaatatcttgagctctgtgatggctaagagagaccttctttttctttctttcttttttttttttttgagacggagtttttttgtttttttgagatggagtctcgctctgttacccaggctggagtgcagtggcacgatctcagctcaccgcaacctccgcctcccgagttccagtgattctcctgcctcagcttcctgattagctgggattacaggcgcccgccaccacgcccaactaatttttgtatttttagtcgcgacggggtttcaccgtgttagccaggatggtcttgatcacttgacctggtgatccgcccaccttggcctcccaaagtgctgggatgacgggcgtgagccaccacgcccgtttgctttatgacttctaccagctcacagaagtctcctgtgtacatagaactccacttcccagccaggctcagtaactcacgtctgtgatcccagcactttgggaggctgaggcaggcagatcatgtgaggttgggagttcgagaccagcctggccaacatggtgaaaccccatctctagtaaaaatacaaaaattagccgagtgtggtggcaggcacctgttatcccagctgcacagcaggctgacacaggataatcgcttgaacccgggaggcggaggttgtagtgagccgagatcgcgccactgaattccagcctgggcgacagagtgagactccgtctcaaaacaaacaagcaaacaaaaatacccattacaatgttgttttaagattgttgtatatcaactgggcatggtggctcatgcttgtaatcccagcactttgagaggccgaggcggacagatcacgaggtcaggagatcgagaccatcctggccaacatggtgaaaccccatctctagtaaaaatacaaaaattagccgggcgtggtggtgggctcctgtaatcctagctactcgggaggctgaggcaggagaatcgcttgaacccgggaggtagaggttgcggtgagctgagatcgtgccactgcactccagcctgggtgacaagagcaaaactccgtctcaaaaaaataaaaaatttaaaaaaataaagaactcgacctcccaaaggtattggctaactccacgggcaaaaaaaccatacccattacaatgctgttttaagattgttgacctggtgcggtggctcatgcctgtaatcccagcactttgggaggctgaggcggacgaatcatgaggtcaggagatcgagaccatcctggctaacacggtgaaacgccatctctactaaaaatacaaaaaaaaaaaaattagccgggcgtggtggcgggcgcctgtagtcccagctactcgggaggctgaggcaggagagttgcttgaaccaggaggcggagcttgcagtgagctgagatcgtgccactgtagtccagccagggcgacaagagtgaaactccatgtcaaaaaatttaaaaaaattaaataaaagaactccacctcccaaaggtattggctaactccacgggcaaaaaaaaaaaaccataccccttacaatgccgttttaagattcttacgtatctcttcgaactccaacctgtcaccgttttagatccaaacccaccaatcacgaacctaaggatgaaagcaaaggctcagcagttgacctgggaccttaacagaaatgtgaccgatatcgagtgtgttaaagacgccgactattctatgccggtaaatcatactctctattgtttttttatttttattttatttatttatgtatttatgtatttatttattttttgagacggagtcttgctctgtcgcccaggctggactgcggtgacccgatctccgctctctgcaacctccacctcccaggtccatgccattctcctgcctcaacctcccgagtagctgggactacaggcgcccgccaccatgcccggctaatttttttgtatttttagtagagatggggtttcactgtgttagccaggagggtctcgatctcctgacctcgtgatctgcccgcctcggcctcccaaagtgctgggattacaggcgcgagtcaccgcgcatggcccagactctctaatgttgacgaacaagacgtttccgtcttctgcaggaatctcagaaccaatactgctcccatcgctggtgtcatgactacctggtttctgccccgaagtcaggtgtgggatttgaagtgactttggagggtctggttccccgtccgcgggacatctaagatggcacacactggacagggtggatgtgaaagtgaaatgaggctaagctatgactggtgcgaaacccaaccccacgctgggcgtggtggctcacgtctgtaatcccagcactttgggaggctgaggcgggcggatcatgaggtcaggagttcgagaccagtctggccaacacggtgaaacgctgtctctgctaaaaatacgaaagttagccgggcacagtggctcacaccagcactttgagaggctgaggcggatggatcacctggggccaggagttcgagactagtctgggcaacatggtgaaaccccgcctccactaaaaatataaaaattagctgggcatggtggtgggcgcctgtaatcccagttacttgggaggctgaggcaggagaatcgcttgaacccgggaggcagaggttgcattgagccgagactgtgccactgcactccagcctgggggacgagagcaagacttcatgtcaaaaaagaaaaagaaaaattagccggatgtggtggcacatgcctgtaataccagctattcaggaggctgaggcaggagaattgcttgaacctgggaggccgaggttgcactgagccgagattgtgccactgcactccagcctgggtgacagagtgagactccatctcaaaacaaaaacaaaaacaaaagcaaaaacaaaacaaaagtgtgtgctcaggaaacaaggtcctcatcacgaaatccttccaaatcccccatcttgtcatcacctgcgttctcagggtttgagaacagcgccagacctcatggggtggcccaggtgacactgtgagctatttacaagtcagtgtcttatgggaaaggagcacgtttccctgagaacctatttggtcccctccaagagctatgttcgttcaatacaattcaaatcacggcccttcatgcgtctgctcgggccaccattataaaatcctacccccagctccaaatacagtcccattgaactttgtgattttggagagtagagataaaacagtctagaatcccagagcgattttaccataccatggcaaactgactctcaactttagaaacacaaatgctgaaaaaaaaactaaggaaattttgaaaaagaaggtgaatgaaggagaacctgccttacctatatcaaaaggcactgaaaagttcatacccaatgtgcggattgctataagaatacacaagtaggccgggcgtggtggctcacgcctgtcatcccagcactttggaggccgaggcgggtggatcacgaggtcaggagatcgagaccctcctggctaacacggtgaaaccccgtctctactaaaaatataaaaattagccgggcgtggtggctggtgcctgtagtcccagctactcgggaggctgaggcaggagaatggcttgaacctgggaggcagaagcttgcagtgagccgagatcgcgccactgcactccagcctgggcgacagagcgagactctgtctcaaaaaaacaaaaacaaaagcaaacaaaacgaagaatatacaagtagattaatgaaatgtggccgggtgcggtggtgaggcaggagaattgcttgaacccgagaggtggaggttgcagtgagctgagatcgcaccactgaagtctagcctgggcaagcggagtgaggccctgtcttaacaaaaaaacaaagaaacaaaaaacaaacaaacaagaaaaaaacaaagcaaaacaaacagaaaagtatttcactaatatttactgctaagtgggattatttttattcaagcttttgtatctttagaaaaaaattgtggccgggcgcggtggctcacgcctgtcatcccagcactttgggaggccgaggagggtggatcacgaggtcaggagatcgagaccctcctggctaacacggtgaaaccccgtctctactaaaaatataaaaattagccgggcgtggtggcgggcgcctgtagtcccagctacttgggaggatgaggcaggagaatggcatgaacccgggagggagaggctacagtgagccgagatcgcgcccctgcactccagcctgggcgacagagcgagactccctctcaaaaaaaaaaaaaacagaaaaaagtcttggccgggcacggtggctcacgcctgtaatcccagcactttgggaggctgaggcaggcggatcacatgaggtcaggagttcgagaccagcctgaccaacatggtgaaaccctgtctctacccagaaaaatactttaaaaattagctgggcgtggtggcgggcacctgtaatcccaggtgctcgggaggttgaagcaggagaatggcttgaacccgggagggagaggctgcagtgagccgagatcacgccactgcactccagcgtgggcgacgagagcgaaactctgcctcaaaaaaaatctgaacatcattagcgtcaaattaagcatggtctgtcagcagccatcatagtcctatgtctctcttaggcagtgaacaatagctattgccagtttggagcaatttccttatgtgaagtgaccaactacaccgtccgagtggccaacccaccattctccacgtggatcctcttccctgagaacagtgagaaaaatgttcattgtttgtttattctctattccctccctccttccctctctccctccctctcgccttcgctgtgtcttttttcttttctttttctctttctttctttctttctttctttctttctttctttctttctttctttttctttctttctgtttctgtttctttcttcctttctttttctttctttctttccttctttcctctctttcttttctttctctttccctccctcccttctttcttttcttcacttccttccctccctccttctctccttttcctccctcctccttcccaccctacttcctctctctccttccttccctttcgttttcttttcctccctgcctcactcccttccttccttctctccctcctcttttccttccttcttccctccttccctttctctctctctctctttctctctttccccctcccctcccttcccctcctctcccctctcctttcctgacacggtcttgctctgttgcccaggctggagcgcagtggtgcaatcacagcttactgcaggcttcacctcctgagctcaaacaatccttctgcctcagcctcccacgtaggtggaactacacccatgtaccaccatgcccacctaattttttaaacacctttttttttttttagacagagtctcactctgtccaccaggctggagtgcactggcgcgatctcggctcactgcaacctctggctcccgggttcaagcgattctcctgcctcagcctcccgagtagctgggattataggcgcccaccgccacgcccagctaattcttgtatttttagtagagatggggtttcaccatgttggtcaggctggtctcaaactcctgacttcgtgatctgcccgcctcggcctcccaaagtgctgggagtacaggggtgagccaccgcgcccagccttaaatactttttgtagagatggggtgtcgctatgttacctgagctggtctcaaactcctaggctcaagtgatcctcccgcctcagtctcccaaagtgcagggattgtaagcatcagccaccacgcctggcctcttctttgttttttaattaattagaagtccatggtttatttttttgttttgttttgtttgtttttctgtgatggagtcttgttcttgtcgcccaggctggagtgcagtggtgcgatttcagcttaccgcaaactccgcctcccgggttcaagcgattctcctgcctcagcctcacaagtagctgggattacaggcacccgccaccaagcccggctaaattttgtattttaagtagagacggggcttcaccatgttggtctcgaactcctgaccttgtgatccacccgcctcagcctcccaaagtgctgggatgacaggcgggagccactgtgccgggcctcaatttaattatttttaagtttaatggatttccagggagttatgccgagtcggaaaaaaaagaccactccagagcgtgacacacacagtgatttcattaatacaactgtcttgaaatggcaaaattttacaaatagaaaacagtctcctgggttgcagggatataagcaggagtgagagctgagagaggtgggtttggctgtaaaagtgctccttggggaggccgggcgcagtggctcacgcctgtaatcccagcactttgggaggccgaggcgggcggatcacctgaggtcaggagttcgagaccagcctggccaacatggtgaaaccccgtctctactaaaaacacaaaaattagccgggcatggtggctcacgcctgtaatcccagcactttgggaggccgaggcaggcggatcacctgaggtcaggaattcgagaccagcctggctaacatggtgaaaccccatctctactaaaaatacaaaattagccaggggtggtggcacatgcctgtagtcccagctactcaggaggctgaggcaggagaatcacttgaacccgggaggcggagattgcggtgagctgagatcgtgccattgctctccagcctgggcaacaagagtgaaattccatctaaaaaaaaaaaaaaattaaaaagaaattagcggccgggcccagtggctcacacctgtaatcccagcactttgggaggccgaggtgggtggatcgcgaggtcaggagatcgagaccatcccggctaacatggtgaaaccccatctctactaaaaatacaaaattagccaggggtggtggcacatgcctgcagtcccagctactcaggaggctgaggcaggagaatcacttgaacctgggaggcggaggttgtggtgagccattgagctccagcctgggcaacaagagtgaaactctgtcttaaacacacacacagatgcacacacacgcacacacacacaaacaatgaaagaaaaacatctgtagtcccagcagtttgggaggctgaggcgggtggatcacttgaggtcaggaattcgcgaccagtctgggcaacatggtgaaaccccatctctactaaaaatacaaaaattagctgggtgtggtagtgggtgcctgttgtcccagatacttgggaggctgaggcaggagaattgcttgaacccgggaggtggaggttgcagtgagccgagatggcgccattgtactccagcctaggcgacggagcgagactctgtaaaaatgaataaataaatcattaaaagaatatgcaggatctctccatattattattattttttacaacggcttgtgtatctaccatggtctcaaaatacaaaaggcactctaaaaaggaattagagttttatttttttttttgagacggagtctcgctcttgtcacacaggctggagtgcagtgacgtggcctgggctcactgcaacctctgcctcctgggttcaagaaattctcctgcctcagcctccctagtagctgggattacagcggcccgacatcacgcccggctaatttttgtatttttagtagaggcagggtttcaccatgttagccaggccggtctcgaactccggacctcaggtgatcctcctgcctcggcctcccaaagtgctgggattacaggcgtgagccaccatgcctgggtttgtttttttatttttttgagacgaaggctcactctgtcgcccaggctggagtgcagtggcgtgatctcagctccatgcaacctctgcctcctgggttcaagaaattctcctgcctcagcctcccgagtagctgggattacagcggcccgacatcacacctggctaattttttatatttttagtagagactgggtttcaccatgttagccaggctggtctcgaactccggacctcgggtgatccacctgcctcggcctcccaaagtgctgggatcacaggcgcgtgccaccagacacagctaatttttgcatttttagtagagattgggtttctccatgttggccaggctggtctcgaactcctgacctcatgtgatccacccgcctcggcctcccaaaatgctggggtgacaggcgtgagccaccgcgcccggtcccgattcgagttctctttcatgtttgtgaacccaggtgggaagccttgggcaggtgcggagaatctgacctgctggattcatgacgtggatttcttgagctgcagctgggcggtaggcccgggggcccccgcggacgtccagtacgacctgtacttgaacgttgccaagtaggtgtgcccgtgggcagaggccgggctgtccctggtgcgggtgccatcggcgtggggtcgtcccccaaccttaccgcttaccgcagcaggcgtcaacagtacgagtgtcttcactacaaaacggatgctcagggaacacgtatcgggtgtcgtttcgatgacatctctcgactctccagcggttctcaaagttcccacatcctggtgcggggcaggagcgcagccttcggtatcccctgcacagataagtttgtcgtcttttcacagattggtgagtagcccgggacactccctcccaccctcagttctgtgataccacggctttagcgccaggccagatcccacgggaccacgtggctcccaacgcagacgttggcctctcacatttccagaggctggacgttggaggtcagcgtgctggctggctgggctcctcgggaggtctcttcctggcttggagagagggtcatcttctcactgtgtcttcacgtggtgtagagagagagagagatgaagttctggggtctcttgttagaagggcactaacaccatcatgggtcccatcatgggtcataggatccctcaccatgggtcatgggaccccccatcatgggttccatcatgggtcccatcatgggtcatagaatcccccatgatgggtttcatcatgagtcatagaaccccctatcatggattccatcatgggtcatgggaacccccatcatgggtcccatcatggttcataggatcccccatcatgggtttcatcatgagtcatagaaccccctatcatggattccatcatgggtcatgggaacccccatcatgggtcccatcattggtcataggaccccctatcatgggttccatcatgggtcatgggacaccccccatcatgggttccaccatgagtcatgggatccctcatcgtgggttccatcatgggtcatgggaccccccatcatgggttccatcatgggtaataggacccccccatcatgggttccaccatgagtcatgggatcccttatcatggattccatcatgggtcatgggaccccctatcatggattccatcatgggtcatgggacccccccatcatgggtcccatcatgagtcatgggatccctcatcatgggtttcatcatgggtcataggacccccatcatggattccatcatgggtcatgggaacctccatcatgggtcccattatgggtcatagaattccccatcatgggttccatcatgagtcatgggaccccccatcatgggttccacatgggatccctcatcattggttccatcatgggtcataggatcccccatcataggtcccatcatgggttccacatgggatcccccatcataggtcccatcatgggtcatgggaccccccccatcatgggttccatcacgggtcatgggaccccccccatcatgggttccatcacgggtcatgggaccccccccaatcatgggttccatcatgggtcatgggaacccccatcatgggtttcatcatgggtcataggatcccctatcatgggttccatcatgggtcatgggaccccccccatcacgggttccatcatgggtcatgggaacccccatcatgggtttcatcatgggtcataggatcccctatcatggattccatcatgagtcatgggatccctcatcatgggttccatcatgggtcatgggacccccccccccatcatgggtcgtgggacccccacccccatcatgggtcatgggagcccccattgtgagtcatggaatccctcatcatgggtctcatcatgggccatgggtcccaccatgggtcatgggagcccccatcatgagtcatggaatccctcatcatgggtcatgggtcccatcatgggtcatgggagcccccatcatgggtcatgggtcccatcatgggtcacgggagcccccatcatgggggtccaccctcataacttcagcccacgccagtcacctcccaaagaccccaccttctaacaccgcccaaccaggggttagagcttcagtggaggaatttgggacagaaggacacacactttcagtccacgatacccgagctccgaggaacctcccaggtggtgagaatgtcaatatgcccagagctgacgtgccctgaacccaagggcagggtgctcggatgcttcagaagaggagggggaaacgaggaagaggaggagaaggacaaggagaagagaagggaggagaggaagaacatgagcagggggaggaggaggagaaggaaaagaaacagaggaaaaggagggggaggaggtagagatggagagggaaggaagaggaggaagagaagaaaacggagaaagaggagggggaggaggaggaggaagagaaaatggagaaagaggagggggaggaggtggagatggggaggggaggaagaggaggaagagaagaaaacaggagggggaggaagagaagaaaatggagggaaaggagggggaggaggtggagatggggagagaaggagcaggaggaggagaagaaagaagaggaagaaaggaggaggagagggtggaggaggaagagggtgaaggagagagggaggagaatggagaggaggaggaggcgggggagggaagagaaggaggtgaggaggaggaaggggaggatagagaaggtggggtagaagggtggtgaggtggggagggagaaggagggggaggaggagagaggaggactggggggaggaagggggaggaggggagagaggaggagggaggagggagaaggagggggagaggatggaggaaggggagcagatggaggaaggcgagcaggagggggaggaaaaaggaggggcaggaggaagaaggagcgggaggagaggaggaggaggaggaggagaatgggcagggaggaggagagggaagaaaaggagggggaggaggaaggagggggaggagggtggagggggaggagggtggagggggaggagggtggagggggaggaggaaggagggagaaggaggggagaggatggaggaagaggagcaggagggggaggaaaaaggaggaggggcaggaggggaggaggagaaaggagagtggaggaggagggtgacaaggagaatggggaggagagaggagtggtagaaaaaggagagagaggaagagtaggagcggagggggaggaggggaggggaggggaggggagaaagaccaggagggtaggaggagggggaggaggaggagggggccagggctggacttccttccaggggcccaggggagacccagccaggcagccggacacacagggctgggctggtagtcgggtcacacctgaggatgtggaagtgcctggggttcccgggaagtggaggatgtcctgggccactgggagaggcggcacatcccctggggggcggaggtgggggaggtgagaagccaggcaggggccaggaagtggaagcttcaggaggatgtgtgcaggtcaaagtgtaggagtctgcatcttgaatgatgcagagagggcctccaaggctccagtgtgctgcaggtgggcagagggggcatgggaagtaggggttggccctgggcaggggtggggagtgggccaggctgcccagcggggctgagcctagagatggaaggggcagggacaaagatgtgcagctgccagtccttggaaaagctgaacgcctggtacttcagagaacaaaagggtggttctgaaggctgctcccaggacagtggggctccgagggtgcaaccccaaggctcactcctcccagtgcccccaacgcggctcagtcctgtgtctctgcctgtagagtttctttgttccctcttccttcctggtgtttttctctcccgctctccaaatgcataggagaagtaatttgaagtatctccagaaaaaaaaagagaaaaagaaaaagaattgatttcttgtactcctaaatcctaaaagtgtttttctcgttgctagagatattaactccacccaacatgactgcaaagtgtaataagacacattcctttatgcactggaaaatgagaagtcatttcaatcgcaaatttcgctatgagcttcagatacaaaaggtaaactttcaccccgcccccagcccccccacccccgtggacatcccttatttttggtaagtcgcactctggggccttgaaacgggcaacaatctcctctgataacgtcacagaaggcatggatcattaaaaaacaaaaacaaaaacaaaaggccgggcgctgtggctcacgcctgtcatcccagcactttgggaggctgaggcaggtggatcacaaggtcaggagatcgagaccatcctggctaacgcggtgaaaccccgtctctactaaaaatacgaaaaaaaattagctgggcgtggtggcacggtcttgtagttccagctactggggaggccgaggcaggagaattgcttgaacccaggaggtgggggttgcagtgagccgagatcgcgccattgcactccagcctgggcgacagagcgagactccgtctcaaaaaaaaaaaaaaagtttgagactgtatgtggtctgttgttttttatttttattatttctattgttatgtggttttttaattttttcttgaactttcttttttcttttgtagtgatctacagattcaatgcaagcttcccagatatttttgatccacagttcgttggatcagttgaacataaatattgatttatttattgagccactctggctctgtagcccagactggagtgcagtggcttaaatcttgactcactgcaacctctgcctcccgggttcaagtgattctcctgcctcagcctcccgagtagctgggattatgggcacccatcaccacacccagctaagtttttgtatttttagtagaaacagagtttcatcatgttggccaggctggtctcaaactcctgacctcaggtgatccacccgcctcggcctcccaaagtgctgggattacaggtgtgagccttcgtgcgcagcctatgtgttatatttagtttgtattttattttattgtattttattatttatttatttatttttgagacggagtcctgctctgtcacccaagctgtttgtttgtttgtttgtttgtttattatttttgagacggagtcctgctctgttgcccaggctggggtgcagtggcatgatctcagctcactgtaacctccgcctctcgggttcaaccaattctcagcttcagcctcctgagtagctggaattacaggcacctgccaccatgcctggctaatttttttttgtatttttagtagagatggggtttcaccatcttgtcctggctggtcttgaactcctgacctcatgatccacccgcctcagcttcccaaagtgctgggattacaggcgtgaggcactgtgccccgccatatatttattatttatgctcaaatactaattatttcatatgcaatttttctgtaagtctaaatctgctaaaaaacgttaggtctattaatttcttttatattaccaagtgttttttagccaatctgtttgggttttttttttttttaagaaaataaatggctgggtgcagtagcttacgcctgtaatcccagcactttgggaggccgaggcaggacgatcacgaggtcaggagatagagaccatcctggctaacatggtaaaaccccgtctctactaaaaatacaaaaaaaaattagctgggcgtggtggcgggcgcctgtagtcccagctacttgggaggctgaggcaggagaatggcgtaaacccagaaggcggagcttgcagcgagctgagattgtgccactgcactccatcctgggcaacagagtgagactccgtctcaggagaaaaaaaaaaaaagaaaataaatacagcacagacttctttctttcactgatttgagggagcaggcatagctgcagccacaggcagagtcgtagctagtctgatgttgcaccccctacctagttcgctggcctggcataggctgtctgtggctacccctgagtgcatctggacacagtctgggaggacggtgggtcttgtttgtccaccggcctcacaaagccccctcccaccaaggtcttgccacagtggcccataagaaaccttttgggccaggcgcgatggggcatgcctgtaatcccagcactttgggaggccgaggtgggcagatcatgaggtcaagagatcaagaccatcctggccaacatggtgaaactttgtttccactaaaaatacaaaaaattagccaggcgtggtggcacgcacctgtagtcccagctactcgggagactgaggcaaaagaatcacttgaatccgggaggcggaggttgcagtgagccgagatcacgccactgcattccagcctgggtgacggagtgagactccgtctcataaataaataaacaaacaaaccttttggtcaggtgctatttactcctaagctcattattttgcccccactgctgcccgaaggccttcccagagccctcactgttttgctggttttcctggagggagaaatttgagtttgggaggaggaggctttcagggacggtccagacactcaaaagtttgcttgcttttgtgttgcagagaatgcagcctgtaatcacagaacaggtgagtgttccctacccccagccgctgtacttgacattgcaaagggtgagttttattattattaagaataaaatgataaaaaatattaataattcttattaataaaataatgaaaatattattaataataaatgttattattcaatgttcagtgactttcattggacagactcttgagtgtcacccttactgcgatcttgcaaaattgggatatttcacatccccaaattgagggatgggaaaaggaagagtcagggatgacacctcccaaggtgtgagagccagatgctatggctggccaggtgctgtccaaacgaggtccacccatttgccccagattccttaccctgggccaggcagccccagtccagcaggaacaagctaccaaaccatagctccacccagcagagacaagcattcagacaggtggcccagacctcagacagaggaccctcccccagcccctgcctgggatctgcaggaacagacagccggaccacagcattctctgtcccctctctctctgtccatctctttccccgtatctctttctctgtctctgaatctctctgcctttctccctccctctctttctctctctctcgtctctatctccctccccctctctgtatctccctccctttttccctccctctatctttctggctctctccctgtgtctatctctccctgtccccatctctctctgtgtctctttccctccctctctcattctccttccctctctctatctttctctccctgtctctatctcccgctccgtgtctgtctctatctttctccctttctccctccatctctctctccctgtctctctctccccgttcccatctctctctctgtgtctctgtctctccctctctcattctccctccctcttttattctccctccctctctttctctctctctctctctctcctggtctctgtctcccccctccccatctctttctctgtgtctgtctctgtaaccttctccatttctccctccatctctctgtctctccctgtgtctatctcccactgtccctgtctgtttctccgtgtctgtctctgtatctctctccctttctccctccatctttctctctctcccccggtctctatcttcccttctccccatctctctctctctgtctgtctctgtatctctctccctttctccctccatctttctctctctctcccggtctctatctccccctctccccgtctctttctccgtgtctgtctctgtgtctctctccctttctccctccctccatctttctctctctctcccggtctctatttcctccctccccatctctttctctgtgtctgtctctgtatctctctccctttctccctccatctttctctctctctcctggtctctatctccccctctccctgtctctctgtgtctgtctctgtatctctctccctttctccctccctctctttatctctctctctctctctgcctctatctcccactgtccaaatctgtgtctctgtctctccctctttcattctccctctctttctctatctctctccttgtctatatctccccctctcccagtctctctgtatctctgtatctctctccctttctccttccctctcttcatctttctttttgaaacggagtttttctcttgttgcccaggctggagtgcgatggcacgatctcggctcactgcaacctccgcctcccaggttcaagcgaatctactccctcagcctcccaagtagctgggattacaggcactcgccaccatgcccaactaacttttttttttttttgtatttttagtagagacagggtttcactagtgggccaggctggtctcgaactcctgacctcaggcgatccacctgcctcatcctctcaaagtgctggaattacaggtgtgagccaccgtgcccggcccctctctttatctttctagctctctccctgtctctctctcccttcccctctctgtctctctctcccttcccctctctgtctctctctcccttcccctctctgtctctctctcccttcccctctgtctctctctcccttcccctctctgtctctctctcccttcccctctctgtctctctctcccttcccctctgtctctctctcccttcccctctctgtctctctctcccttcccctctctgtctctctctcccttcccctctctgtctctctctcccttcccctctctgtctctctctcccttcccctctctgtctctctctccctttccttctctgtctctctctcccttcccctctctctctctccattcccctgtctctatgtctctccctttctctctcccattatttctctgtgattgtctctttctttctctgcctctgtctgtctgtccccctgtattagtccattgtcacactgctgataaacatatacccaagactgggtaatttataaacaaaagagggttcctggactcacagttccatgtggctggggaggcctcacgatcacggcagaaggtgaaggaggaggaaaggcatgtcttacatgtcagcgggcaagacagaatgagacagtcgccgggcgcagtgactcatgcctgtaatcacagcaccttgggaggacgaggtgggtggaccacgaggtcaggagttcaagaccagcctggccaacatggtgaaacctagctctactaaaaataaaaaaaattacccagacgtggtggtggcaggcgcctgtggtcccagctactcgggaggctgaagcaggagaatcgcttgaacccgggaggcagaggttgcagtgagttgagatcgcgccactgcactccagcctgggtgacagagtgagactccgtctcgagaaaaaaaaaaaaaaaaaaaaaatgagagccgagagaaaggtttcccttattaaaccattagatctcgtgagacttattcactaccccgagaacagtgtggggggaaactgcccccatgattcagttatgtcctacccagtccctctcacaacacgtgggagttataagggctacaattcaagatgagatttgggtggggacacagccaaactacatcacccactctctctgtctctctgcttctgttttcctctctgtctctgtttttctttccctctctctgtctctttgtatctctgtctctctctctctgtctccgtttctatctctgtctctctctgtccatcacccactctgtctctttgtctctctatgtctctctgtttctgtttttctgtttttctctttccctctctctttgtatctatgtctttctgtctctccgtttctgtctctctctctgtccatcacccactctgtctgtctttgtctatgtctctctgtttttctgtctctttttctctttccctctctgtctcccctctctgtgtctctttgtatctccgtctctccctgtctgtttctatctctgtctctctctgtccatcacctactctgtctctttgtctctgtctgtttctgtttttctttctttttccctctgtctcccttctctgtgtctctttgtatctctgtctctctctgtttctatctgtctctctctgtccatcacccactatctctgtctatgtctgtttttctgtctctgtttttctctctccctctctctgtctcccctctctgtgtctctttgtatctctttctctctctctgtctctccctgtctgtttctatctccgtcctcctgtattagtccattttcatggactaatgaggatccttcccgcttctcccagctcctggggactctggggtccctgggcttgtggccatatcactccactctctgcctccgtctccacatggccttctcctctgcatccgtgtctcctttttatttatttatttatttattttgagacagagtctcgctctgtcacccaggctggagtgcagtggtgcgatctcagctcactgcaacctccgcctcccaggttcaagcgattcccctgcctcagcctcccgagtagctgggactacaggtgcacaccaccacgcctggctaatttttgtattattagtaaagatgggattttaccttgttgctcaggttgacctcgaactcctgacctcaggtgatctacccacctcagcctcccaaagtgctgggattacaggtgtcagccaccgcgcccggccacgtctcctcttcttataaggatattggtcattgcatttagggccccccctgatccaaaatgacatcatctcaatctatatcttaacgacatctgccatgaacaggtatttcatcataaggccccattgtaaggtgctgggggctaagactgcaacatatgaattttgggggatcacaatgcagcctcattcttttgtacccatcaaatatgaatggtcttttcttcttttttttttttttttgagacggagtctcgctctgtcacccaggctggagtgcagtggcgcaatctcggctcactgcaagctccgcctcccgggttcccgccactctcctgcctcagcctcctgagtagctgggacctcaggcgcccgccaccgggcccggctaattttttgtatttttagtagagacggggtttcactgtggtctcgatctcctgaccttgtgatctgcccgccttggccctccaaagtgctgggattacaggcgtgagccaccgcgcctggccgagctatttcatcataaggccccactgtaaggagctgggggctaagactgcaacatatgaattttgggggatcacaatgcagactcattcttttgtacccatcaaatatgaatggtcttttcttctacttttttgtttggtttttaatttcagacaggctctcactctgtcacccacgctagagtgcagtggcacagtcacggctcactgcaatctctgcctcctgggctcaagggatcctcctgcctcagccccccaagtagctgaaactacaggcgtttgccaccaggtcagctcatttaaaaaaaaatttggctgggcgcggtggctcacgctggtaatcccagccctttgggaggccgaggcgggtggatcatgaggtcaggaaatcaagaccatcctggctaacatggtgaaaccctgtctctactaaaaaaaaaaatacaaaaaattagctgggcatggtagcgggtgcctgtagtcccagctactcgggaggctgaggcaggagaatggcatgaacccgggaagcggagcttgcagtgagccgagatcacgccactgcactccagcctgggggacagagtgagactccatctcaaaaaaaaaaaaatttttttttggctggacgtggtggctcacactggtaatcccagcactttgggaggctgaggcgggtggatcaccggaggttgggagttcgagaccagcctgaccaacatggagaaaccccgactctactaaaaatacaaaattaaccgagcgtggtggtgggcgcctgtaatcccagctactcgggaggctgaggcaggagaatcgcttgaatctgggaggcggaggttgcggtgagccgagttggtgccactgcactccagcctgggcaacaagagtgaaactctgtctcaaaacaaaacaaaacaaattttcttctagagatggggtcttggtttgttgcccaggctggtctcaaactcctaagctcgaggtatccccccacctcagcctccctggtagctgggaccaaagacatgtgtcaccacgtctggtaatttttacagttttttttttttggtaaagatggggtcttgctatgttgcccaggctggtgtcaaactcctgggcttaaggaattctcccacctcagcctccaaaagtgctgtggtgagaggcataaaccgtagcacccagcccctcttttcttcttttatttatttatttatttatttatttatttatttagagacagagtctcactctgttgcccaggctgcagtgcagtggtgccatctcgcctcactgcaacctccacctctcaggtttaagctattctcctgcctcagcctcctgagtagctgggattacaggtgcctgccaccatgccaggctaatttttgtatttttagtagagacagggtttcaccatgttggccaggctggtctcgaactcctgacctcaggtgatccacctgccttggcctccctaagtgcccaggtgagagtcatgagccaccatacctggcccctcttctttattttctttcaaaccacaggtcagagacagaacctccttccagctactcaatcctggaacgtacacagtacaaataagagcccgggaaagagtgtatgaattcttgagcgcctggagcaccccccagcgcttcggtgagtgggctgtgcggggtgcgcggggtgagcggggtgagcggggtgcgcggggtgagcggggtgcgcggggtgagcggggtgcgcggggtgagcggggtgagcggggtgagccgggtgcgcggggtgagccggctgcgcggggtgagcggggtgagcggggtgagcggggtgagcggggtgcgcggggtgagcggggtgagcggggtgcgcggggtgagcggggtgagccgggtgcgcggggtgagccgggtgagcggggtgcgcggggtgagcggggtgagcggggtgcgcggggtgagccgggtgcgcggggtgagcggggtgagccgggtgcgcggggtgagcggggtgagcggggtgagccgggtgagccgggtgagccgggtgcgcggggtgagccgggtgcgcggggtgagcggggtgcgcggggtgagcggggtgcgcggggtgagccgggtgcgcggggtgagcggggtgcgcggggtgagcggggtgcgcggggtgagccgggtgcgcggggtgagcggggtgagcggggtgagccgggtgccccgggtgagcggggtgcgcggggtgagccgggtgcgcggggtgagcggggtgagcggggtgcgcggggtgagccgggtgcgcggggtgagccgggtgcgcggggtgagccgggtgagcggggtgagcggggtgcggggtgcgcggtgcgcggggtgagcggggtgcgcggggtgagccgggtgcgcggggtgagcggggtgagccgggtgccccgggtgagcggggtgcgcggggtgagccgggtgcgcggggtgagcggggtgcgcggggtgagcggggtgcgcggggtgcgcggcgtgagccgggtgcgcggggtgcgcggggtgagcggggtgcgcggggtgcgcggggtgcgcggggtgagcggggtgcgcggggtgcgcggcgtgagccgggtgcgcggggtgagcggggtgcgcggggtgagcggggtgcgcggggtgagccgggtgcgcggggtgagccgggtgagccgggtgcgcggggtgagcggggtgcgcggggtgagccgggtgagccgggtgcgcggggtgagccgggtgcgcggggtgagcggggtgcgcggggtgagccgggtgcgcggggtgagcggggtgcgcggggtgagcggggtgcgcggggtgagcggggtgcgcggggtgagccgggtgcgcggggtgagcggggtgagcggggtgagccgggtgccccgggtgagcggggtgcgcggggtgagcccggtgagccgggtgcgcggggtgagccgggtgcgcggggtgagccgggtgagcggggtgagcggggtgcgcggtgcgcggggtgagcggggtgcgcggggtgagccgggtgcgcggggtgagcggggtgagccgggtgccccgggtgagcggggtgcgcggggtgagccgggtgcgcggggtgagcggggtgcgcggagtgagcggggtgcgcggggtgcgcggcgtgagccgggtgcgcggggtgcgcggggtgagcggggtgcgcggggtgcgcggggtgcgcggggtgagcggggtgcgcggggtgcgcggcgtgagccgggtgcgcggggtgagcggggtgcgcggggtgagcggggtgcgcggggtgagccgggtgcgcggggtgagcggggtgcgcggggtgagccgggtgcgcggggtgcgcggggtgcgcggggtgcgccgggtgcgcggggtgagccgggtgcgcggggtgagcggggtgcgcggggtgcgcggggtgcgcggggtgagccgggtgcgcggggtgagcggggtgagccgggtgcgcggggtgagcggggtgagccgggtgcgcggggtgagcggggtgcgcggggtgagccgggtgcgcggggtgagcggggtgcgcggggtgagccgggtgcgcggggtgagcggggtgcgccgggtgagcggggtgagcggggtgagccgggtgcgcggggtgcgcggggtgcgccgggtgcgcggggtgagccgggtgcgcggggtgagcggggtgcgcggggtgcgcggggtgcgcggggtgagccgggtgcgcggggtgagcggggtgagccgggtgagcggggtgcgcggggtgagccgggtgcgcggggtgagcggggtgcgcggggtgagccgggtgcgcggggtgcgcggggtgagccgggtgcgcggggtgagcggggtgcgcggggtgagcggggtgcgcggggtgagccgggtgcgcggggtgagccgggtgcgcggggtgcgcggggtgcgcggcgtgagccgggtgcgcggggtgcgccgggtgcgcggggtgagcggggtgagccgggtgcgcggggtgagcggggtgcgcggggtgagcggggtgcgccgggtgagccgggtgcgcggggtgagccgggtgcgcggggtgagcggggtgcgcggggtgagccgggtgcgcggggtgagcggggtgcgccgggtgagcggggtgcgcggggtgagcggggtgcgccgggtgagcggggtgcgcgggctgagcggggtgcgccgggtgagcggggtgcgcggggtgagcggggtgcgccatcctgggtcacggaaacactcctctcctgcaaaggagaggagattcactcccccagtttctgtgaccccaaaaaggaccctgaacccgacggtgaactcacagcttgctcttactcacgagaggagacgtggaggggaaacaaggtcgtcccactgacagacaccccctgggccttgtaataaagaccgaggcgggcggatcacaaggtcaggagatcgagaccatcccggctaacacggtgaaacccggtctctacaaaaaatgtaacaaattagccaggcgtggtgatgggcgcctgtagtcccagctactcgggaggctgaggcaggagaatggcgtgaacccgggaggcggaggttgcagtgagccgagatcgcgccactgtgctccatccagcctgggcgacaagagcgagactccatctcaacaacaaaacaaaaggatcgcctcagagtagaacttctggccgggcacggtgactcatgcctgccatcccagcactttgggaggctgaggtgggtagatcacctgaggtcaggagttcgagaccagcctgaccaacatggaaaaaccctgtctctactaaaaatagaaaaattaggtcaggtgctgtggcttaagcctgtaacctcagctaccagggaggctgaggcaggagaatcgcttgaattgtgttccctcaaaattcgtgtgttgaagctttgatcccccaggacctcagaatgtgactgtgtttggagttggggtgtttaaagaggcgattaaggtaaaatgaggtcattagggtgggccctaatctaacaggactggggtccttataagaagaggagatgaggacacagacacacacagagggacgaccctgtgggacacagggagaagacggcgtctccaagcccaggagaggggcctcaggaggaaccagcactgcccacacctggatctcagacctccagcctccagggctgtgggagaatcaatgtgttttgtttctaagccgcccagcctctggtattctgtgacagcagcctgagatggactaagccatctcataagaagagacgaggacacagacacacacagagggacgaccctgtgagggcacagggagaagacggcgtctccaagcccaggagaggggcctcaggaggaaccagcactgcccacacctggatctcagacctccagcctccagggctgtgggagaatcaatgtgttttgtttctaagccgcccagcctctggtattctgtgacagcagcctgagatggactaagacatctcataagaagaggagatgaggacacagacacacacagagggacgaccctgtgagggcacagggagaagacggcgtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagacatctcataagaagaggagatgaggacacagacacacacagagggacgaccctgtgagggcacagggagaagacggcgtctccaagcccaggagaggggcctcaggaggaaccagcactgcccacacctggatctcagacctccagcctccagggctgtgggagaatcaatgtgttttgtttctaagccgcccagcctctggtattctgtgacagcagcctgagatggactaagccatctcataagaagagacgaggacacagacacacacagagggatgaccctgtgagggcacagggagaagacggcgtctccaagcccaggagaggggcctcaggaggaaccagcactgcccacacctggatctcagacctccagcctccagggctgtgggagaatcaatgtgttttgtttctaagccgcccagcctctggtattctgtgacagcagcctgagatggactaagacatctcataagaagaggagatgaggacacagacacacacagagggatgaccctgtgagggcacagggagaagacggcgtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagccatctcataagaagagacgaggacacagacacacacagagggacgaccctgtgaggacacagggagaagacggcgtctccaagcccaggagaggggcctcaggaggaaccagcactgcccacacctggatctcagacctccagcctccagggctgtgggagaatcagtgttttgtttctaagccgcccagcctctggtattctgtgacagcagcctgagatggactaagccatctcataagaagagacgaggacacagacacacacagagggacgaccctgtgagggcacagggagaagacggcgtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggagtaagacatctcataagaagaggagatgaggacacagacacacacagagggacgaccctgtgggacacagggagaagacggggtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagccatctcataagaagagacgaggacacagacacacagagagggacgaccctgtgaggacacagggagaagacggcatctccaagcccaggagaggggcctcaggaggaaccagcactgcccacacctggatctcagacctccagcctccagggctgtgggagaatcaatgtgttttgtttctaagccgcccagcctctggtattctgtgacagcagcctgagatggactaagacatctcataagaagaggagatgaggacacagacacacacagagggacgaccctgtgaggacacagggagaagacggcgtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagccatctcataagaagagacgaggacacagacacacacagagggacgaccctgtgagggcacagggagaagacggcgtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagccatctcataagaagagacgaggacacagacacacacagagggacgaccctgtgagggcacagggagaagacggcgtctccaagcccaggagaggggcctcaggaggaaccagccctgcccacacctggatctcagaactccagcctccagggctgtgggagaatcaatgtgttttgtttctaagccgcccagcctctggtattctgtgacagcagcctgagatggactaagacatctcataagaagaggacatgaggacacagacacacacagagggacgaccctgtgggacacagggagaagacggggtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagacatctcataagaagaggagatgaggacacagacacacacagagggacgaccctgtgggacacagggagaagacggggtctccaagcccaggagaggggcctcaggaggaaccagccctgcccacacctggatctcagaactccagcctccagggctgtgggagaatcaatgtgttttgtttctaagccgcccagcctctggtattctgtgacagcagcctgagatggactaagacatctcataagaagaggagatgaggacacagacacacacagagggacgaccctgtgaggacacagggagaagacggcgtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagccatctcataagaagagacgaggacacagacacacacagagggacgaccctgtgagggcacagggagaagacggcgtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagccatctcataagaagagacgaggacacagacacacacagagggacgaccctgtgagggcacagggagaagacggcgtctccaagcccaggagaggggcctcaggaggaaccagccctgcccacacctggatctcagaactccagcctccagggctgtgggagaatcaatgtgttttgtttctaagccgcccagcctctggtattctgtgacagcagcctgagatggactaagacatctcataagaagaggacatgaggacacagacacacacagagggacgaccctgtgggacacagggagaagacggggtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagacatctcataagaagaggagatgaggacacagacacacacagagggacgaccctgtgggacacagggagaagacggggtctccaagcccaggagaggggcctcaggaggaaccagccctgcccacacctggatctcagaactccagcctccagggctgtgggagaatcaatgtgttttgtttctaagccgcccagcctctggtattctgtgacagcagcctgagatggactaagacatctcataagaagaggacatgaggacacagacacacacagagggacgaccctgtgggacacagaagacggggtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagacatctcataagaagaggacatgaggacacagacacacacagagggacgaccctgtgagggcacagggagaagacggcgtctccaagcccaggagagaggcctcaggaggaaccagccttgcccacacctggatctcagacctccagcctccagggctgtgggagaatcaatgtgttttgtttctaagccgcccagcctctggtattctgtgacagcagcctgagatggactaagacacctcataagaagaggagatgaggacacagacacacacggaggaacaaccctgtgaggacacagggagaagacggcatctccaagcccaggagagaggcctcaggaggaaccagccctgcccacacctggatctcagacctccagcctccagggctgtgggagaatcaatgtgttttgtttctaagccgcccagcctctggtattctgtgacagcagcctgaaacggactaagacatcccataaaaaggagatgaggacacagacacacacggagggacgaccctgtgggacacagggagaagacggcgtctccaagcccaggagaggggcctcaggaggaaccagcactgcccacacctggatctcagacctccagcctccagggctgtgggagaatcaatgtgttttgtttctaagccgcccagcctctggtattctgtgacagcagcctgagatggactaagccatctcataagaagagacgaggacacagacacacacagagggatgaccctgtgagggcacagggagaagacggcgtctccaagcccaggagaggggcctcaggaggaaccagcactgcccacacctggatctcagacctccagcctccagggctgtgggagaatcaatgtgttttgtttctaagccgcccagcctctggtattctgtgacagcagcctgagatggactaagacatctcataagaagaggagatgaggacacagacacacacagagggacgaccctgtgagggcacagggagaagacggcgtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagccatctcataagaagagacgaggacacagacacacacagagggacgaccctgtgaggacacagggagaagacggcgtctccaagcccaggagaggggcctcaggaggaaccagcactgcccacacctggatctcagacctccagcctccagggctgtgggagaatcaatgtgttttgtttctaagccgcccagcctctggtattctgtgacagcagcctgagatggactaagccatctcataagaagagacgaggacacagacacacacagagggacgaccctgtgagggcacagggagaagacggcgtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggagtaagacatctcataagaagaggagatgaggacacagacacacacagagggacgaccctgtgggacacagggagaagacggggtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagccatctcataagaagagacgaggacacagacacacacagagggacgaccctgtgagggcacagggagaagacggcgtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagacatctcataagaagaggacatgaggacacagacacacacagagggacgaccctgtgggacacagggagaagacggggtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagacatctcataagaagaggagatgaggacacagacacacacagagggacgaccctgtgggacacagggagaagacggggtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagacatctcataagaagaggacatgaggacacagacacacacagagggacgaccctgtgggacacagaagacggggtctccaagcccaggagaggggcctcaggaggaaccagccctgcccacacctggatctcagacctccagcctccagggctgtgggagaatcaatgtgttttgtttccaagccgcccagcctctggtattctgtgacagcagcctgagatggactaagacatctcataagaagaggacatgaggacacagacacacacagagggacgaccctgtgagggcacagggagaagacggcgtctccaagcccaggagagaggcctcaggaggaaccagccttgcccacacctggatctcagacctccagcctccagggctgtgggagaatcaatgtgttttgtttctaagccgcccagcctctggtattctgtgacagcagcctgagatggactaagacacctcataagaagaggagatgaggacacagacacacacggaggaacaaccctgtgaggacacagggagaagacggcgtctccaagcccaggagagaggcctcaggaggaaccagccctgcccacacctggatctcagacctccagcctccagggctgtgggagaatcaatgtgttttgtttctaagccgcccagcctctggtattctgtgacagcagcctgaaacggactaagacatcccataaaaaggagatgaggacacagacacacacggagggacgaccctgtgggacacagggagaagacggcgtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagacatctcataagaagaggagatgaggacacagacacacaccaagggacaaccctgtgggacacggagaagacggggtctccaagcccaggagagaggcctcaggaggaaccagccctgcccatgcccatctcttgatcttggacctgcagcttccaggactgtgggagaatcaattccttttttctttttcttttttcttttttttcctctttttctgagatggagtctcactctgtcgccaggctggagtgcagtggcgtgatcttggctcactgcaacctccacctcgcaggttcaggccattctcctgcctcagccttctgagtagctgggatgacaggcgcccgccaccacacccggctactgtttgtatttttattagagacgggctttctggccatgttggccaggctggtctcatactcccgacctcaggtgatccgcccgccttggcctcccaaagcgctgggattacaggcgtgagccaccgcgcccggccaaattccttttttctgaagccaccaagctgtgggacttttttatggcagtcccagcagacagatccaccctcgttccaaataaggttatcgtcataggttctgggggtgaggtcatagatgtatgtttttttttttttttggagagagagtctctctctattgcccaggctggagggcagtggcgcgatcacggctcactgtagcctcgacctcctgggctcaagcgatcctctcgggaggctaagagaggagaatcgtttgaatccgggaggcagaggttgcagtgagctgagatagcaccacagcactgcagagcgagactctgtctcaaaaaaaaaaaaaagaaaaaagaaaaaaaataggccgggtgcgtggctgacgcctgtaatcccagcactttgggaggccgaggcgggtggatcacttgaggtcaggagttcaagaccagcctaacgaagatggtgaaaccccatctctatgagaaatacaaaaattacccgggcgtggtggcgggcgcctgtagtcccagctactcgggaggcaggggcaggagaatcgcttgaacctgggaggtggaggttgtgagctgagatcgtgccactgcactccagcctgggcgacaaaacgagactccatctcaaaaaaaaaaaaaaaagaaaaagaaaaagaaaaaattaacacacacacacaaattccatgataaacacaaaatcaagttcaaagcacgcacgccagtgctgcctctgctgcccctccatgctgcccacacccaaagcacctgccggcctgctgggcacagtggaagtccctggcgctccccgtgtcccgagcaccaggcagacagggatccctggtggtctttccgctcccttagggttccagactggggctgggaggtccggaagtcgctcccggtcctggtactcaggtggcctgcaggtggcccgcaggtggtcacggtctctgtgcaggtggcactactggggtgtccccccctggacgccaccccatatggcagccacctctctgcttcccagggccccggggagagcttacagtccctggtccccccaggacggcccccggtctgtgaccctctcaccctttacccctagagtgcgaccaggaggagggcgcaaacacacgtgcctggcggacgtcgctgctgatcgcgctggggacgctgctggccctggtctgtgtcttcgtgatctgcagaaggtgagccctcgagggcgtccgcgagcgtcgcttgtttccagtgtgaccctgaaagttattcacagaaccatcctgagaattatcattattatttttgtgatggagtctcgctctgtctcccaggctggagtgcagtggcacgatctgggctcactgcagcctctgcctcctgggttcaggcgatcctcctgcctcagcctcccaagtagctgggattacaggcacccagcaacacacccagctaatttttgtatttttagtagagacggggttttgccatgttggccaggctggtcttgaattcctggactcaggtgatccacctgcctcagcctcctaaagtgctgggattacaggcgtaagccacctcgcctggcccatattattattattgttatgattattattattttttgagtcttgctctgtcacccaggctggagtgcagtggctcgatctcggctcaccgcagcctccacctcccgggttcaagtgattctcctgcctcagcctcccgagtagctgggattacaggtgtgcaacactgcacccaactaattcttgtatttttagtggagacggggtttcaccatgttggccacactggtgttgaactcctggcctcaagtgatcccccagcctcggcctcccaaagtgctgggattacaggcgtgagccaccgcacctggccccttgagaattattcacaaaagaccaggggccaggtcctctctgctagctgccccctgccaggaggtctgtagagccaaagctgagggctctggtgggaccaagggtgtccccagggtggaggaagcagggccggtcctcccctgccctgcccagcgggcctgacacagtcagagggcgaaaggccaggctttctggtcgggaaggggcctgggcgaacgtcacagctgtccacttggatgggccaggatccgtcatgcagaccaactcgaggtttttggtcaccagctgggtcaccccaggtcctgtctccttttttttagagaaggagttttgcttttgttgcccagcctggagtgcaatggcgccatctcggttcactgcaacctctgcctcctgggttcaagcgattctcctgcctcagcctccctgagtagctgggattacaaggatgtgccaccacgcctggctaattttgtatttttagtagagatggggtttctccgtgttggtcaggctggtcttgaactcctgacctcatgtgatccacccgcctcggcctcccaaagtgctgggatgacaggcgtgagccaccatgcccggataattttgtattttcagtagagacggagtttctccgtgttgatcaggctggtcttgaactcctcacctcagttgatctgcccgcctgggcctcccaaagtgctgggatgacaggcgtgtgccaccatgcccagataattttgtatttttagtagagatggagtttctccatgttggtcaggctgttctcgaactcctgacctcagttgatctgcccgcctgggcctcccaaagtgctggcattacaggcttgagccaccatgaccagccaggccctgtttccttcctgctgggcatcagagcttcacaatctgtcaaatgggtgccatggtgacttctgtctcccgggggaagggggaaaaggggagggggagggggaaggggaagaggggggaggaggggggaagggaggagggggaagggaggggggaaaggagggggaagggaggagggggaagggaagagggggaggagggggaaggggaggaggaggagggggaggagaggcgagggggagggtgggggagggggaagggggaggaggagaggggaggatgagtggggagggggaaggagggagagggggagggggagagggaggggtaggggggaaggggtggaggagggaggaaaagggggaggaagagggggacgaggcccttcctgcaagctgtctcaggtcgtaaactcagtgacctgaggcaccaggggtctgtctttgcagctgcacccctgggtggctccggtaccagcgccctactcctttaattagacaccagcgcctgcctatgatgatggtcgggggcgtgtcagggcctcaggggccgggaaaatagagacccctcgagtagatgacttgagtcttttgctctgtcctggcactgtctgtcctggacacgctgtgtcccagatgatgagctggtcggttttgggttcagagctgggccatttctctttcctccgaggtatctggtgatgcagagactctttccccgcatccctcacatgaaagaccccatcggtgacagcttccaaaacgacaagctggtatgttgttttttctgccttgggacgggtctggaggcgtggtggccactttgggaggcccaggcgggcggaccacttgaggccaggaactggagaccagcctggccaacatggagaaactccgtgtctactaaaaatacaaaattagccgggtgtggtggcgggcgcctgtaatcccagctactcgggaggctgagggaggaggatcacttgaacccgggaggtggaggctgcagtgaactacgatcgagccactgcactccatctgggcgacaagagtgaaatggcctggactaggaggctggacacctgtctgctggcgctggtgggcggctgggaaaagctgcaggatgaagggagtggggggacactgggctcccagcccaccgtgatcacgggccgtctccgcaccctgcacaccagagcagagcagatttttttttttttttttagatggagttttgctcttgttgcccaggctagagtgcaatggtgcgatcttggctcaccacaacctccaccttcccagtccaaggttcaagcgattgtcctgcctcagcctcccgagtagctgggactacaggcacgcaccgacacgcccagctaattttgtatttttagtagagacggggtttcaccatgttggccaggatggtctcgatctcctgaccttgtgatccccctgcctcggcctcccaaagtgctgggattacaggcatgagccaccatgcccagcctagttttcaacaagtttttagtgatacctgtgtccctaagagaaaggaagggcagaggaaaaggaggcagacatctctgtcagagttttttgttttgttttgttttgtttgtttttgtttttgagacgcagttttgttcgttgccccggctggagtgcaatggtgcaatctcggctcactgcaacctccaccttcccggttgaaggttcaagcgattctcctgcctcagcctcccaagtagctgggactacaggcatgcaccaacacacccagctaattctgcatttttagtagagaaggggtttcaccatgttggccaggatggtctggatctcctgaccttatggtccgctcgcctcggcctcccaaagtgctgggattacaggtgtgacccaccgcgcctggcccaaagtgctgggatgacaggcgtgagacaccatgcctggcccacagagcagatctgagatgggacaggcccccgcagatcaggacgtgggctctgttatctggggggtggccgactcaccctgcctcctctcgtctctgcaggtggtctgggaggcgggcaaagccggcctggaggagtgtctggtgactgaagtacaggtcgtgcagaaaacttgagactggggttcagggcttgtgggggtctgcctcaatctccctggccgggccaggcgcctgcacagactggctgctggacctgcgcacgcagcccaggaatggacattcctaacgggtggtgggcatgggagatgcctgtgtaatttcgtccgaagctgccaggaagaagaacagaactttgtgtgtttatttcatgataaagtgatttttttttttttaaccca

SEQ ID NO: 28 - DNA, 24252 bp, Homo sapiens
gccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccaggtaggggctgggtcccgaacgcctgcgcctggaacagggtctaattgagggggttgggggttgtcagaggatgagttggaggaatgcggttcagtcctcagcatcctccctaatcaaataatagtaattctcgtgctttgtgcaacgccacgcggcgcagtacctggcactcagtagctaaggaaatattagtggagcaaaggcatttagctttacataatttagtgagtgcttttttttttttttttttttttttgacagagtctcactctgtcgcccaggctggagtgcagtggcgcgatctcggctcactgcaacctctgccgcccgggttcaagcgattctcctgcctcagcctcctgggtagctgggattacaggcgcctgccatcgcgcccggctaatttctgtatttttagtggagaccgggtttcactctgttagccaggatggtctcaatctcctgacctcagatgatccacctgcctcggcctcccaaactgctgggattacaggcgtgagccaccgcgcccggcccaagtgttctttttttaaatggagttcttcgaagcctcttccttgcaatttcaaactaggcgatgggactttattaatttcgtttcgcagaggaaactagggcacagagaggttagataactggcctaaaatcacacagccagtgcttgaatacgcaggatctgaccctgcagcgccccccagcgctctccacgctgctgggtctccccctctgagaaacggggggacaggacccccttttacaaaaggcccaaagggaggctgactgagcggcgcagagccagtgctggagacccgggactgtccctcaggacctttccctctcactgaggcgactctcacttacttccccggaaaatgtggggggctctgggtcgaggaattcgagaaggaactgagtcagggcgggtggccacagggtgttggggccgcgatgaataacccggaaagcgctcgagaccgcgggaggccgggaatgagtaacagctccgggatactccgaacgcgcagctggaaagggatgtccgggaaggcccggaggtcggggaccgggcctagggactgggctgcaatctcggggcggagcctggggcggggagagagtgtcggggaggagccagagggcggggctggaacctcaaggaagagctacgggagaggttacagaccgaggaagagctaggagcggggctagaacctcgaggcggagccagagggcggggttataacctcgaggcgtaaccagagggcggagttataacctcgggaggagctagaaggtgggactagactcttgaggggcaggattataacctcggggaggagctagagggcggggctggaacctcaaggaggggctaggggcggggttataagcttggggaggagctacggggctgggctaggacctcaaggggccaaggggcgggggttacgacctcggggaggagctacagggtggggctgaaacctcaagaagggactggggcggagttatgacctcaggggaaaactaggggcggggagagctaaagggcgaagttagaatctcaaggaggagctagagggagggactaaagcctcgaggaggagctaggggcggggttatggcatcggggaggagctagggggcgggaagataaggtcaggaagagctaaagggcggggctagaacctcgacgatgagtctggagcggggccaaaacctagttggagagctggagggcggagacagaacttcgcgggaaactagagtatctaacaatagaaactccggagggctgatggggccgggcctagaatttgggaataaattagtgggccgggagaggctctggagccgggtagaaccagggggagtgagtggagggatagttccattagggcactgggagtgacggtataacataaagatcgacgcgggtggggcaaggctagaacgtccccagcagaactggagaggcgtaatcgaccgagggccggtgcggtgagaaagacctaataggagcaggaatagaacgtactgatagagagggcggggatacgactgtcaggatatacgcctcacgaggacagaatgaaaggaaaaacgggccaaggcaggactttgggaaaggacttgtgggcagggatagaacgttcagttagtggggtggaggtagaacgtggacaacggacagactggaagtaccgccggccggaacccagcagaacatggacacgaatctgaatggacggggcctggagacttggtgttggtattgggacatgcaggggtgagcgggggtcttggagctaagcgtagttaacctctcctctcctctccctccttcccccagcctcttggggcctgcggtgcatgcagtgtaagaccaacggggattgccgtgtggaagagtgcgccctgggacaggacctctgcaggaccacgatcgtgcgcttgtgggaaggtgagcttccccccaacccacacacccctccagcgcagcatggaacgcgagtgattgagaaaccttcctcaccagtaactgggacatgcaaactaaaaacaaacaaacaaggagagcccatttcacacccaccagattggcaagcatttaaaaatctgacaatacccgggttagtaaggatgtggagttgcagaccgtgtctgtggtgggggagtaaattggcacatcaaccacttagagcgattcggcaatatctagtccagatgaagattaacatatgctacagctcaactcctcgccatgcagaaatgccaaagaaccttggccacatatacccagggacacatgtatacgaatgttcttagcagcaatgtttgtgacatggaaaattggaaacaggctgggcactggctcacacctgtatttccagcactttgggaggcagaggcggatgaattgcttgaggtcaggagttcaagaccaggctggccaacatggtgaaacacccgtctccacacacacacaaaaaaggaaaaattagccgagtgtggtggcacgcacctgtaatctcagctacttgggaggctgagacaggagaattgcttgaacctgggaggtggaggttgcagtgagctgagatcatgctactgcactccagcctgggcgacagagcgagatcctgtcaaaaaaatgaacgaaagagagaaaggtgggccgggcatggtggctcacacctgtaatcccagcactttgggaggctgaggcaggtggattacctgaggtcaggagttcaggaccagcctggccaacatggtgaaaccctgtctctactaaaaaatacaaaaattagccgggcttggtggcaggcaccagttatcccagctactcgggaggctgagacaggagaattgtttgaacccaggaggcggaggttgcagtgagctgagattgtgccattgcactccagcctgggcgacaagagcaaaactccatctcaagaaagaaagaaagaaaggaaaggaagagagagagagagaaagagagagaggaagggagggagggacggagagaggcagggagggagggagggaggagggaggaaggaaggggagaaagaaagaaaagaagaaaatggaaacgactttatgtcagtcagcaagtcagcagcagaagagaaacactgtggtaataattacataatggagcgctctactgcagcttaaagaaggaaatagagctgcagataccaatgtggacacatctcagaaacctaaggttgagagggaaaaaaatgttgcagaatatgatacgttttttataagctttaagaacacatgaaacaacagtatatgaagccaagcacagtagctcacatttgtacccctagctactcaggaggctaaggcagaaggattccttgagcccagaagttcgaggttgtggtgagctatgattgccccagctgggacaacagagaccctgtttctaataaataaataaataaaataaagttacatttgaggcatctcagtactgagatcactaagctgagggtgtgggggagggatagatggatccagaaagtcccagttgtagtgctgtcactacaagagcaggagtgggacacagtggctcacacctgtaattccagcactttgggaggccaaggtgggaggatcacttgaggccaggagtttgagatcagcctgggcaacatagtgagatgccatctgtataaaaaatttaaaaattagcagggtgtggtgatgtaagcctgtggttccagctactcgggaggccgaagcaggactgcttgagcctgggaggtcaaggctccagtgagctatgattgcaccactccagcctgggtgacagagcaagaccctgtctcccggaaaaaaaaattaattaattaattaattgaaataaaatagagcaggctccttgttggggtgggggtggaggcaaggttaactctagaaaaagacagagttcgactcaaataacagaagaggcctagcagagatcagccctgggagtggatgaccttgagaccaggagtgtcagaggctggttgagctgagaggagcctctggggtaatgaagatcccctccttgcagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggtgagtagggcagcccttgccatccccaaccccaagccatccccagctcaacctcatcatcatcccaatcctattcttaactttacatcagctgaaccccaactccatgccttatccaagtcccaaccccaacccaacccatctctagctcagctccatccccaactcattcttgaccccatatccaaccccaactcaacttcacctccaatcctatgcccaacttcatgttaccctaacactgttcccaactcaaacccagccctgttccaagcacagttccaaccccatccccaaatcaaccccatccttatctcagactacccaaatccccaccccaacgacacaattactttcatccttaacccaatccccatcctgcatgtttgtatgtatggttgttatgtataacttgcaactctgcccttaacaagctcacacgcatgcatgagacatagatgagatgtctcagtgatgtttgtccatctgactgggcaggagatggtcctgcccaatccattgggacgggagatggtccaagcaatagatactgaggggccaggattcaagcaaagacttgacgttcttaagggaagtcgaaagaggggaagattaaatgggccgcagtaggctgggagaatcctctgcaatagatggtctctgacttgggcagtgaaaaaacaaatgtgaggaaatgtccataataggctgggtgtggtggctcatgcctgtaatccaagcactttgggagaccaaggcgggagaaccgcttgagcccaagagtttaagaccagcctgggcaacaaccataagcccctttgtcgaatttcatggcttcaggctctgatcattttaagaaaaagacttagaaaaggtcaaattttcctaaattcccacaggagaggaagggtggggaaggaatgggtccatggtgcatggatccatccgtgaaagagattcctctttctggacctggtgaggaaggaaatagggtaaggccagtctagtcatggttggtgacatcagtgagcagagtgctgcgtttgcactgggttttctttgttcttcattcatcctgattctgcctggttttcatccatcctgacctcaaacactaatccgctggtggggccaaatcagatgtttgttttgaggaagtgacgagaggatgtgggcttcccgtctcggtgagatgtgcttaaggaaagcaccaatacttgggtctaagtagtgcattcaatcagagatgatagcgaaaatatttaacaatattggtcagtgctgggacaaactcctggagtccgctgctgggcctggtgttgcccctttccatgatgggtcacagggacatgaagggtcctggggagagagttggcagtggtcagggatccaccaggagcttagagcagcagctatcaattcaggaatctaataactgagatacctatatcatccctttttcttttcttttttctttctttttttttttgtttccttttgtttttgttttttttttttgtttgtttgttcgtttgagatggagtttcactcttcttgcccaggctggagtgcaatgccacgatctcggctctctgcaacctccgcctcctaggctcgagcgattcttctgcctcagcctcccaagtagctgggattacaggcatgcgccaccacgcccagctaattttgtatttttagtagagatgaggtttctccatgttggtcaagctgatcttgaactcctgacctcaggtgatctgcccgcctcagcctcccaaagtgctgggattacagacgtgagccaccgtgcccggcctcatccccatttctaatgccattgtaccctgcttgtggcaacttgcatagttggttaaactgcactcagtacttacatgatgctgggaacacagcagggaccaagacagccttgtgccctgcctgactccatgggactcacagtcctgtgtgtgtgtgtgtgtgtgtgtgtgtgtgtgtgtgtgtgtgtgtgtgtgtgtaggggtgacagacccatccatcaccagacagtgactgattattaggttaatgcaaaagtaattgtggcttttgccattaaaagcaatggcagaaaccacaattacttttgcaccaacctaatagatttgtctgggctatgaagggggaaacacaggcagaggggtcagggctgggatgagggaagagtaggagctgtgggaccctagaggagatacctgactcaggtcagggaaggtttcctaggggaagcaacagctaagctggatcttgaaggatgagtaggaatcagactattaaacagctaatggaggctgggtgcagtggctcacgcctgtaatcccaacactttgggaggcccaggtgggaggattgtttcagaccagcctaggcaacatgactctacaaaaaaattaaaaaattagccagatgtgatggtacatgcctgtgatcccagctccttgggaggttgaggcgggaggatcactatagcccaggtggtggaggctgcagtaagctatgatcgcaccactgtaccccagcctgggtgacagagcgagatcctgcaaaaaaaaaaaaaaacagtggaaagggttttccagcagagggagcagcagatacaaaggtggccaaaagcagtgtggctggacaaaggaaacagtacagtggggcgagatgagctggaaagcttggcaggggcatgttacacaggggtttctagacattgtcctgggagcactggggcatcacagaagattttaaacagcgaatgtcatgatcgcaattatttatttatttatttttgagatggagtttcgctctttttgcccaggctggagtgcaatggtgcgatctcagctcactgcaacctccgcctcctaggttcaagtgattctcctgcctcagcctcccaagaaactgagattacaggcacccgccaccatgcccggctaatttttttgaatttttagtagagatggggtttcaccatgttggccaggctggtctcgaactcttgacctcgtgatccacccacctcggcctcccaaagtgctgggattacagacgtgagccaccgcgcccggcccccatttatatttttaacaaattattctgacctcaggacagaagatagactgaaaggaagcaagagtagatgaggggaaaccaacttgggggtgggcgaggttgtccaggtggagaagagggcagcaggactagggtgtcaggtgtgcagaggaagaaaagtggatagatttaagagctattcaggctaggcacagtggctcacgcctgtaatcccagcactttggaaggccaaggcaggaggactgcttgatcccaggagttggaggctgcagtgatcacgccactgcactccagcctaggcggcagagcaaaaccctgtctcaaccaaagccgaacaagagctattaagaagcaggccttagtggtggattagatgtgggaggggacctgcaattctggtcatgatggagtcacttgtatcagaccaacccttctgccaatgacagttgcaaatgctggacaaataataaacaattattggaagtcactggagagcagcaaatgaaaggagaaacttggctgggcaaagtggttcatgcctgtaatcccagcactttgggaggccaagacaggtgaattgctcgagctcatgagttcaagaccagcctgggcaacatggcgaaaccccgtctctactaaaaatacaaaagttagccaggcgtggtggcacatgcctgtggtcccagctacttgggtggctgaggcacaagaattgcttgaacccgggaggtagaggttacagtgagccaagatcacacgactgcactccagcctgggcgacagcgcgagactccatttcaaaaaaaaaaaaaagaaaaaagaaagaaaggagaaacttgaggcgctacaatctctgaaataacagaagtgtagaatttgggttccacagacaacctggctttttcccggagcgcacttgccaatctgctgctgtggaagggaaatagagcccagacggaaagagagtcgctagactgagaagacggaggttggagtttggggctgccagaatgtctggaagatgagagttaaaatcctggaatggatgggaccacagaaaagggagttcccaacctgcaaacaaatctccctcaagtcattggcaagctctacatgcacagggtgagagtccaagaaacttggaagagaaaaatagcaactgggaagctacaaaagcgaacaaggcttccagcagacatgtgatgctggggacacaggttgccaagctgaagaggccttggtaagcatctcaggctttccccctaagaccaccccaggggtaagggccaaagtgaaatagaccagccctaaacaagcctaggtccagtccttgacaggaatgaaaacctgactctctgtggaagaagaaaacatcgtttaggcccttgacagatttttatctagaatgtctggcgtctgatcaaaatttacaagatagctaggcatggtggcatgcgtctgtagtcccaactacttggaaggatttcttgagcctgagagttctgggctgtagtgtgctatatcaaccgggtgtctgcactaagtttggcatcaatatggtgatctcccaggagcaggggaccaccaggttgtctaaggaggggttgaagcagcccaggtcagaaatggagcaggtcaaaactcctgtgatgatcagtagcaggattatgcctatgaatagccactgcacaccagcctggacaacatagcaagaccccatctttaaaaaaaaaaaaaaccaggccgggcatggtggctcaagcctgtaatcccagcactttgggaggccgaggtgggaggattacaaggtcaggagttcatgaccacactggccaacatggtgaaaccccttctctactaaagatacaaaaaaaaaaaaaattagccgggtatggtggcacacacctgtaataccagctacttgggagactgaggcaggagaattgcttgaaccagggaggtggaggttgcagtgagccgagatcacaccattgcactccagcctgagcgagagggcaagactctgtctcaaaacaaaacaaaacaaaacaaaacaaaacgcaagactctgtctcaaaacaaaacaaaacaaaaaacaaaaaataaaaaacagtaacaaaaaaccttacaaggtatcctgaagaaaataaaagggaccaattgaccagaaaccaagagaaaaatccaactgtagaaacagaattgtagcaactcagatattggattataggacaggaaacatgaaaattgctacaatcgatatattcaggaaaacagaagaaaggatatgttttagcacctggaatccattttttaaaagagtccaacagaaaatatagaacagtgactcaaatgaagaactcggcagttatgcttgatagaggtcagaaacagcagagcaaaaggattaaggagctagaagacagaacagtagaagcatgtcggttgatgcacagatgtggaagataagggggtctgccaggtttctgccccggggactggatggggccgccttggacgcgtggacttcaagaaaaagagcagttgtgggagaagatggggagttttgtttaggacaggtgtttgaggtatagccatggggcctcgaagagacagttgcgtgtctggagctcagagagaagtctagactagagagagatttgtgagtgatgagcagatagatggaaatgaagtcatgtcaatatttaccccatgagagagtctatactgtgagagataaaaagggcttaaaacagagccctggccaggtgcggtactcacgtctgtaatcccagcactttaggaggccgaagcggcaggatcatttgagtccaggagttcgagactagcctgggtaacatagcaagaccttgtctctacaaaaatacaggaatcagccaggtgaactggcacatgcctgtagtctcagctactcagtaggctgagatgggagaatcacctgagctcagggaggtcgaggtggcagtgagccactgcactccagccttgggacagagcaagaccctatctcaaaaaaaaaaaaaaagaaaagaaaagaaaaaggaaaatagccctaaggatcattggcatttacaagagttcacaccagagacccatgagtgaccacccagagtgggcagaactagaaatggggaattcaaggggcagtgggagctcagagcaggtacccgttccaggctgatgggtcagggagggcttcctagaggaggtgaaattgaagatgacagctgaagaatgaataggagttagagaaagtagggctcaaggaaaaggtgttctaggtatgaacagctatgttggcaatggtgagaatttgtgttttcattttcatggaagtttgtgtgagaagacgtgggtggccttgtagttatttttctttgagggggacgattgggctttggatgtaaatgattcgcctaattacagctagcggcctgccagttgagaaccttggctgacatggtcctctcacttttttaagacttggcctggactcagcttagatgtgtcttgggtcaggacggggagggcatgccaagcatgggaaatggtgtgagccaagggctgggtagaggaatgactctggtgtttccagggaaaagtaacggatccagttggccaacaccacaaggttcgtgcaaaaggcgaagtgatcaggaatcagtcaagtgagtctttgatccctgggacaattaggtagtgtattatctattgcttatctattatctattgctgcattacagattgcagcaataaaataagcatgtgttatttcacaaagtttctgaaggtcaaaaaccctggagtggcttagctaggtggttctggctcaggatccttcatgagcctgcagtcgagatgtcagctggggctgcagtcatctgaaggctcctaaggtagcttcactcacatgaatgctcccctcccatggctttggcacaggcctcagttctgccacgtgaactttcccatggtgctacttgagtgtcctcacaacatggctgctgcttgccccagaaaaagtgatccaagtgagagagccaggcatgtgttctatgatctagccacagaaggcatacaccatcatttccataatatccagttgactacatagggcatccttattcttttcttcttcttttttttttttaatttaaagacagagtcttgctatgttgcccagactagtctcaaactcccagactcaagcaatcctcccacctcggcctcccaaaatgctgggattacaggcatgagctgctgcacccagccagccctattctttaagggcatgaataccagggagcagagattattgggggccattttggagacaggctaccacagggaacaatagaagggttttaagtaattgctcattcattcattcatttaacaaatatgcattgaatatcttatctgtccctggccatgtgccaggtggtgttgggacacagtagtgatcaagacagcccctggccctgccctcctgggggctcacagtccagtagaggagacatacctgtcaccagacagtgaccacccagagtgggatgggggagtacaggggtgtgtgggagcctggtggatcaggaagggcttcctagaggaggtgaaattagagctgacacctgaagaatgagtaggagttagggaaggcagagagcaaaggaaaggtgttctagacagaaacaacggcatatgcaaaggcctggatgccagggaacatgtgtcgtcgcagactgtgggaagtcagtgtggagcagagtctcagggtgtagtggagggagacgaggcaggagaggtgctcaggccccagtatttgataggctttgaatcccatgctgaggatcttggaatttattttcagggcagtagggagctatggaagagtcttgagcagaggagagacagggtcagatatgagtattagaaatatccttctaagggcccgagtgcagtggctcatgcctgtaatcccagcactttgggaggccaaggcatgtagatcacttgaggttaggagttcgagaccagcctggccaacatggtgaaaccctgtctctactaaaaatacaaaaattagcccagcgtgatggtgcacgcctgtagtcccagctattcgggaggctgaggcaggagaatcacttgaacccggggagtggaggttgcagtgagccaagatggtgccactgcgttccagcctgggtgacggagtgagactctgtctcgggaaaaaaaaaaaaaaaaaggaaagaaatgtttctagggccatgtggagatgctgcactggggtgagtagggggtgacaagaatggaaacccagaggctagggaggtagctggagttgaaggaggtctgagctggactggtccatggggctggaaaggagggggtggattctagaaagattcagcaggcagaataggcagggctcaatgactggctgcagggtgggataaggaggaattgattttgagtgagtccttgcagagctggggctccaggactgtccccatggagtctcactcccctccccctcttccaaacaggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaaggtgagccccaacctgctggcaactcctcctccctgctctgctcctccctaagactgcacttaacaaacaaccccaaagtaacagggatgtcagcaagggactaagttctctcatacacaagaggtccagtgataggaagtccagggccacaaggacaggtccagagtcaccaggaacccagatgccttctcatttctttttatttatttatttatttattttttgagacagagtcttgctctctgtcacccaggctggagtgcaatggcatgatcttggctggctgcaacctccgcctcccaggttcaagtgattctcctgcctcagcctcctgaatagctgggattacaggtgtgcatcaccacgccttgctaatttttgtatttttagtagagatggggtttcaccatgttggtcaggctggtctcaaactcctgaccttgtgatccacccgcctcaacctcccaaagtgctgggattacaagcgtgagccaccacgcccggccaccctcttgtttcttacacattacttccattctcaaaatgcctcatagtctaaaatggctgccagagctccgggtctcacatctaagttccaggaaggaggaagaaggaaagaagggacaaaaaagggggcactcctccttttgtaagggttctcctttctggaagtcccataaagcacttctatttatatcacattagtccgaacttcatcacatgactacctggagaggctggaatatgtagttttcgacaagatctatgactgttctagataaaatgagggtcttatgatgaagggtgaagtagagaatggttgaatgcctgctatttcgggcaaatcccatcttagtccctcattcacaatctgacatctgacctctgtcccctggcccccatagggcgtccaaaggatgaccgccacctccgtggctgtggctaccttcccggctgcccgggctccaatggtttccacaacaacgacaccttccacttcctgaaatgctgcaacaccaccaaatgcaacgagggcccaagtaaggaacgggagacacaggcaaggcctggggtcgggcaggggcatgcactcaggcagacagctgcgcagtcactctctggcaatcaagtcctctctgggcctctgtttgcttttctgaaaaatgggagtatcaggcctttttttttttttttttttttttgagacggagtctcactctgttgcccaggctggagtgcaatggcgtgatctccgctcactgtaaacttcgcctcacgagttcaagcgattctcctgcttcagcctcctgagtagctgggattacaggtgcccaccatcacccctggctaatttttctatttttagtagagatgggggtttcaccatgttggccaggctggtctcgaactcctgacctcaagtgatctgtctgcctcagcctcacaaagtgctggggtaacaggcatgagccactgcacccagccaggcctttcttcaaagaagaacttcgtaaggattcaatgatactatcagccctcgccaagacctgtgcttcctgtctcttttgtctctctcaaattttcccactcctcccctgctccactgccaccacctgggctgagccacgctgacttcttgcccaggttgttgcaatgacctcctctctggtctccctgcttccactcctgccaccctacagccaaggctcaacccagcagcgagtgattttttggggggtatgggggggacagggtctcgctctgtcacccaggctggagtgcactggcatgatcatggctcactgcagcctcaaactcctgggctcaggaattcttcccacctaagctactggagtagctgcgactacaggtgcatgccaccgtacccagctaattttgtatttttggtagagatggggtcttgctttgttgcccaggctggtcttgaactcctgggcttggcctcccaaagtgttaggattacaggcatgagccaccatgcaccaccaattttttattttttaatgtaaatcagatcatgtcaccctcctttctcaggcacttcaatgacttccccttcctcttagaataagatccaaagaccttattctgttggcctatgtaatctggcacctgtctgcctcacagtctttgtttagattcgtttttggggttttgtgttttctttagacatagggtcttgctctgccacccaggctggggtgcagtggcacaatcacggctcactgccacctcaaactcctgggctccagtgatcctcccacctcagcttcccaagtagctgggactacagatgcgcatcattgcacccagctacattttttttttttttctgagatggagtcttgcgctgttgcccaggctggagtgcagtggcgcgatcttggctcactgcaagctccgcctcccgggttcacgccattcccctgcctcagcctcccgagtggctgggactacaggcacccaccaccatgcctggctaatttttgtatttttagtagagacagggtttcactgtgttagccaggatgatctcgatctcctgacctcatgatccgcctgactcagcctcccaaagtgctgggattacaggcgtgagccaccacgcccggccgcacccagctaaatttttaaaacttttgtagagatggggtctcactatgttgccggggctggtatcaaactcccaggctcaagcaatccttctgccttgacctcccaaagtgctgggattacaggcatgagccgctgcacctggccttcatttagtttctttctttcttcctttctttctttttttagatggagtctcgctctgtcagccaggctggagggcagtggcgtgatcttggctcactgcaacctccgcctcccaggttcaagcgattctcctgcctcggcctcccaaagtgctgggattacaggcatgagccgctgtgctgacgttcatttggtttctataatcaccaaagcccatctggtctcatggcccttgcagatgaatatcctcccttagaacacatcttccccaagagttcaccctgctggcaacttctcatccattaggcctcagctttaatgtatcatcttcagggatgctttcactgtccctcccctccagtgtaatctagatccctgtctctattacccagcactgtcaacagatagaaatgttccctatctgtcctgtccaatattacagccaccactgtatgtggtcagtgagcacttgaaatgtgaactgaattttaagattcgatttaatattaatttatttaaatgtaaacaaccacatgtggccagtggctaccagattgggtagtgtagctctaaattgtaaattctggctgggcacagtggctcacacctgtaatcccagcacttttggaggcggaggcgggagggtcgcctgaggccaggagtttgagacaagcctaggcaacatagcaagactccgtctcaaaaaaaattttttagtaataataatagtaataacttgtaagttctggccaggtacagtggctcacacctgtactccgagaacattgggaggctgaggcaggcagattgcttgatcccaggagtttgagaccagcctgagtaatgtgtcaaaaccccatctctacaaaaaacagaaaaattggctaggcatggtggtgcacgcctgtagtcccagctactcaggaggctgatgtggaagaatctcttgagccggggtggtcgaggctgcagtgagctacaattgcgccactgcactccagcctgggcaacaaactgagaccctgtatcaaaaataaataaataagttgtaacttttgtgagagcaaggacagtttcatcttacatagttttacccagcacccagcacggtgcctggccagaaatgggactcatggggagttgaaagttggggtttctctcaagccctcgaaaaccatccccctccaaatgccattcagacgcctgaccacaaggtggctccatgacatctctggctcggagtggaagtcctggggaggtcattcaaggaagtggagatccaagcactaattttcttggtctctgtgtctctggtcttctcctaagtcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacggtgaggccctctccgaggctgggagggaacacttattgggggtggagagttccgcaagagattgacttccagttaagctggagttaactgtggtgggtctccctgtggaaaaggtgggatttccttcaggtgggtgaatattattgtaaggaattaggacttgtccatcaggatgtggacatttttgccatggaaaagtggaattccggctgggtgcggtggctgaagcttgtactctcagcactttgggaggctgaggccggaggatctcttgaggccaggagtttgagaccagcctgggcaacatagcaagacccccatctctacaaaaagaaaaatggaattctttggtggatttctcgtgggttgtggggatttgctgaagacatcttgggctttcatcctgtggtgtcctggaaaggtctctgtattccagtggttctcaaactttttggtctcaacttcttcatgcttttaaaaattatttttggccaggtgtggtggctcacgcctgtaattgcaacaccttgggagggtgaggaggagaaccacttgaggtcaggagtatgagagcaagcctggccaccatggtgaaaccctgtctctacaaaaaattacaaaaattagctgggtgtggtggcgtgcacctataaccccagctactcagggggctgaggcacgagaatcacttgaacccaggaggaggaggttgcagtgagtggggatcaccccactgcactccagcctggatgacagagggagactttgtctcaaaaaaaaaaaaaaactctttattgtttatatcagtgatttctatagataaatgccacattaaaattaaaactgagaaccaggagtggtggctcacgcctgtaatcctagcactttgggaggccgaggtgggtagatcacctgaggtcgggagttcaagaccagcctgaccaacatggtgaaaccccatctctactaaaaatacaaattagtcgggcatggtggcacatgcctataatcccagctactcgggaggctgaggcaggagaatcacttgaacctgggaggcagaggttgcggtgagccaagattgtgccattgcactccagcctgggcaacaagagtgaaactccgtcccaaaaaataaaataaaataaaattaaattaaaattaaaactgagaaatcttttttttttttttttgaaatggagtcttgctctgtcgccaggctagagtgcagtggcatggtctcagctcactgcaacctccccctcctgggttcaagcaatcctcctgcctcagcttcctgcatagctgggattacaggcatgagccaccatgcccagcttatttttgtaattttagtagagacggggtttcaccatgttggccaggatggtctcgatctcctgacctcatgatctgcctgcctcggcctcccaaagtgctgggattacagatgtgagccaccgtgcccagccaaaactgagaaatctttaaagatttatttatgaattcatcttataacaataaaaactcattacacattaagataaataacattttaatgaaaaataagtatagtttccaaagaaaaaatgtaatgatagccaggcatggtggctcatgcctataatcccaatactttgggaggccaaggtgggcgggtcacttaagcctagggatttgagaccagcctgggcaacatagcaagatcctgtctctacagaaaatacaaaagttagctgggcatggtggtgcatgcctgtagtcccagctgcttgggaggctgaggtgggagggtcacttgagcctgggaggtggaggttgcagtgaacggagattgcaccactgcactgcggcctgggcaacagagcgagaccctgtcttaaaaaaacaaacaaagaaacaacaaaaaaaaaaccagccaggcgcggtggctcacgcctgtaataccagcactttgggaggccaaggcgggcagatcacaaggtcaggagttcgagaccagcctggccaatatggtgaaaccccgtctctactagaaatacaaaaattagctgggcatggtggtcgcgcctgtagtcccagctacttgggaggctgaggcagaagaattgcttgaacccgggaggcagaggttgcagtgagccgagatcgtgccactgcactccagcctgggtgacagagtgagactccatctcaaaaaaaaaaacaaaaaaaaagcgtaatgagaaaactggcattattttgctgtgttgcacatctctttaatgtccagcttaatagaagacagctgggtcctcatggaagcttctgctttcagtctcttgcaatatcacatgtcctggagtttttggaaaagcccattgtacacttatgagagtgaaaaagccatgtgaaatcacagatctcctgaaagggtctctggggtccctgagccacactttaagaaccgctgctcgcttcctttctttctttttttttctttccttttctttctctgtctctctttccctttctttctttctttcttccttccttcctcccttccttccttctttcccttctccttccttccttcctccctctctctctctttctttcttttctttcccttcttcccttcctcccttccttcttccctccctccctccctcccttccttcctttctttctttttatttgttttttgaaacagggtctcactctgttacccaggctggagtgcagtggcgtgatcataactcaccacagcctccatctcctgagctcaagtgatcctctcatctcagcctcccaagtagctgggactacagctgtttttttcttttttatgtttgtagaaacagagttttgctatgttgtccaggctggtctggaactcctgggctcaagctatcctctctccttggcttcccaaggtgttgagattacaggcatgagccaccacacctggccctgagaactgctgctttctctaggtggtagtgaaggtggcacccactgcaaggtggcaggtcacctactggagaattccagtcctgggcccaggagctggaagtctcactccgtcttctctttcctcagaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtggacaaggccaggtatgcccttctttgtagtgtctatctttgggaggataaatggtgggggacaccttttcacaggctcctggaatcaggggtcatgtttgaggcccctgcctaggttggaagtcctcctgggggctgcctccacatctatttctggactccaaatgctgacagagcaggagcactgccatcttgaacaaacaccaccattcttagttcctcttgattaaaaatcggctaaatccggacgtggtggcgggtgcctgtagtcccagctattcgggaggctgaggcaggagaatggcgtcaatccgggaggtggagcttgcagtgagccgagattgcaccactgcactccagcctgggtgacagagcaagactctgtctcaaaaaaaaatcagctaaatccagccccaaaacatcagcctaatggctaccatcagcataaccagaaacattccaaccctaagataaacccctctctgaccagaaacatgccaacccccagatagcctcccttccgaccagagactttccaaccccacaataaacttttcctcacatgaaaacattccgaacctagataagcacccccttccaaaactcttaaatatccttagtctgtaaaaaaaaaaaaaaaaaagggctctctaacctaactcagccaaaagcccccctcaggttggttttctctaaaataaacctgtccttcaccgtcaagccacatttcatgtttctttccttttcctttttcttttcttttcttttctttttttgagatggagtttcactcttgttgcccaggctggagtgcaatgacacaatctcagctcaccacaacctccacctcctagttcaagggattctcctgcctcagcctcccaagtagctgggattacaggcatgcaccaccacacccggctaattttgtatttttagtagagacagggtttctccatgttgttcaggctggtctcaaactcccaacctcaggtgatctgcccaccttggcctcccaaagtgctaggattacaggcatgagccaccgtgcctggcctcctctttctttaattcttacaaatgcaagcttccagatcacacactgaacactaaccttctagtcttctcctaaacttcaaaggttgcaactattttgttgttctaaggagacatccccacatttcccagcatgctttgggaaaggagacggatagaagataacctgatggccagaactccctgcatgcactgcagtgaggaataaggacaggagtgcacttcccctgatgtgctggggaccggggataaaggctgggctctatttcccgggatgcctcaggactgtcagaaaaagagacagaactaccatttcaatggcactctaggagcacaatattgaaaaattcatgttcttctcatcatttgctaaggcaacccatggagacaaaaattacattccccatcaaatcttgtggctaatgaagaaaaaataagatatcttcggctggctgtggtggttcacgcctgtaatcccagcactttgggaggccgaggtgggcagatcacttgaggcaggagtttgagaccagcctggccaatttggcaaaaccccgtctctactaaaattacaaaaattaaccgggtaaggtggtgggtgcctgtaactccagctactcggaaggctgaggcaggagaatcgcttgaacccaggaggaggaggttgtagtgagccaagatcacaccactgcatgacacagtgagactatccccaaaaaaaaaaaaaaaaaaaaaaagacatcttccatggtatttgggggcaggtgagggacaaggttcttgtttagggctttctctaatgacatatcaccacctgtcactgtagtggcttaaagaagtgaggtctgtacttctgcctcttgaatatgagtgactctgtgactgctttgaccagtagaatgtggtggaagttttgctgtgctatgttctggaaccaagttttaagaaactttcatttttcactttctgaatcttagaacgctcactctggggaagctggttgccatgtaaaagtactactgccctgagaccaccatgctgtgaggaagcccaagctactcatgtataaatgccatgtggagatagagccccagatgtttcagccatctcagcccaggcaccagacaagtgggtgaagaagccaccttggacatgtagccccagcagatgtgatatagagaagaaacaggaaacttggctatattagtttcctagggctgcctgtgataaattattacaaactttataaactaacacattgtgtgcctatatcaaaacatcatggaaggacaggcacagtggctcatgcctgtagtcctagcactttgggagggtgagaaaggaagatctcttgagctcaggagttcaagatcagcctgggcaacacagtgagacctcatctccactaaaaataaaaaaaaattggctgga

SEQ ID NO: 29 - DNA, 17328 bp, Homo sapiens
tccacccaagagcaacctggaactaagttattcggcaacgaactgttccactttgttgtgaggcaatagatgtggaaattccctgacgaggggctctgtcctcatacttcctgcggagcttattgtcgtaagaatatctgtcatcctgctaatgtgcattgaaaggagagcaacggggctgaggccgtgtcagcacgatggaccccaaacagaccaccctcctgtgtcttggtgagtttcagagtaaaagtgggttagaggggaagatagagaaatcccaaaataatcagggtgtctcttaacagtgtgactaggagattttagtggctgccaaggagattctgatctccttagtggaaaggccgtctttgtcaatgtatctataactttgtctctacccaagcccaagctagcttgtggggctcaaggtttaatatttgtattaaacctatagtgtgttatctgggattcatgatggtcccaaggttcttatcaaggagagacttagaggctggaatctgaaaggtaaaaataaagaatgaacctcaaaactgtgattgttgtggaaggaaaacatatgatagaaccccatatagaaatatggttactagtattttgttgaagatttttgcatttatgttcaacaaagatattatccagaagttttctgtttttgttgtatctctgccacattttgttatcaggataatgttggcctcatagaatgagttggggaggagtccctcctccaggatttttttcaatagtttcagtaggaataatactagctcttcttggccgggcgcagtggctcacacctgcaatcccagcactttgggaggccaaggcaggcggatcacaaggtcaggagatcaaaaccatcctggccaacatggtgaaaccctgtctctactaaaaatacaaaaaaattagccaggcgtggtggcgggcgcctgtagtcccagctactcgtgcggctgaggcaggagaatggcatgaacctgggaggcagagcttgcagtgagccaagatcatgccactgcactccagcttgggcgacacagcgagactctgtctcaaaaaaaaaaaaaaatgccagctcttctttatatatctggtgggattgagctgtgaatccatctggtactggtctttttctggtctgtcattacagagggtgatttgtcgtaaaggttggaaatggaagcttgatttttcataaatctctctcttccagtgctctgtctgggccagaggattcaggcacaggaaggtaagtgtcctgtaaatctctcccagcccctttagaccctcttgggagctctaggataaagaaattgaagaatagcctgaagcaccattcttattttaatccccattctagttgtttctgctgtgcttctcttgcataatttctatctcactttgttatctccaaacccttcagactcattaatgctcaggcctggatttatagttagtccttgcctgtgttagactgtccatgaaggatctgtaatttactgaatgctcaaactgcaagaatgaggaagtcaggagtcatctgcccaatatccttccttatgctgattctattttgttttagcaacccacttcctcccgtcacttcatttaaaaggatgctgccatagtctaaccctactgaacactctagcattctgtagtactactgcagtactaagcatgaggcagtcttagtgtactactgaatattctgccaccccaactactactgccttagcctcctaatgggtgtgagccccacgtccatccatgtcttctctcttccagctccttctaaagcctgaattatttgtgtgttgaacaatactcattcttcctatccatgagcatggaatgtttttccatttgtttgtgtcatctatgatttctttgaccagtgttttgtagttctccttgcagagatctttcacctccctggttagctgtattcccaggtattttattctttttgcagtaattgtgaatggattctattcttgatttggctctcagcttagatgtttttggtgtataggaatgctactgatttttatatattgattttgtatcctggaactttgctaaagttgtttatcagattaagaagtgtttgggcagagactgtggttttctaggtatagaatcatatcacctgcaaacagggatagtttgacttcctttcttcctatttggatgccttttatttctctcttgcctgattgctctagctaggacctccagtactatgttgaacagaagtagtgagagacggcatccatgtcttttgccagttttcaaggggaatacttccagcttttgcccattcaatatgatgttgactgtgagtttgtcatacatcattcttattattttgaaatatgtttcttcaatgcctagtttgtcgaggttttttagcataaagggatgttgaattttatcaaaagctctattgagaggattatgtgtgtggggagggttgttctatttatgtgatgaatcatatttaagatttgtgtatattggccgggcactgtggctcatgcctgtaatcccagcactttgggaagccaaggcttgtggatcatgaggtcaggagatcgacaccatcctggctaacacggtgaaacctcgtctatactaaaaaacacaaaaaaattagccaggcgtggtggtgggcacctgtagtcccagctgctcgggaggctcaggcaggagaatggcgtgaatccaggaggcggagcttgcagtgagccaagttcacgccactacactccagcctgggcaacagagcgagactcctatatcgaatcaaccttgcatcccagaaataaagcctacctgatggtggtggattagctttctgatgtgctgctggatagtttgctagtattttgttgaggatttttgcatttatgttcaacaaggatattgtcctgaagttttctggttttgttgtgtctctgccatgtttttgcatcaagatgatgctggtctcatagaatgagctggggaggcattcctcctcctgaatatttttggaacgtttcagtaggtatagtaccagctcttctttatatatcagatgggattcagctgtgagtctgtctggtactgggctttttctggtctgtaggatttttattactgattcaattttggagctcattattggtctgttcatgtattcaatttattcttggtttgatctcaggagggtgtatgtgtccaggaatttctccatttattctggattttctagtttgtgtgcatagaggtgttcataatattctctgatgattgtatttctgtggggtgagtggtaatataccctttgttgtttctaattgtgtttatccggatcatctctcttttcttctttattagtctaactagtcatctgtcttactaattttttcaaaaattctactcctcgatttgctgatcttctgaatgctttttcgtgtctcaatctccttcagctcagctctgattttggttatttcttgtttcctatgagctttggggttgatttcctcttggttctcttagttcctcttgttatgatgttaggttgttaatttgaactttttctagctttttgaagtgggagtttagtgctataaacttcccccttaacactgccttagctgtgtcccagagattctgctatatttacccaaaaattccagaacagactgcttaatttccatgcattgtacagttttgagtggttttcttagtatttattcctatttttattccactgtgctctgatttcgcttttctggatttgctaaggattgttttttttttttttgaaatggagtcttgctctgtcgcccaggctggagtgcagtggcgcaatctaggctcactgcaagctccgcctcccaggttcacaccattctcctgcctcagcctcctgagtagctgagactacaggtgcccgccaccccgcccggctaattttttttgtatttttagtaaagacggggtttcactgcgttagccaggatggtctcgatctcctgacctcatgatccgccagccttggcttcccaaagtgctgggattacaggtgtgagccaccgtgcccagcctgctaaggattgctgtatgtctgattgtatgattgactttagagtatgtgccatgaggcaatgaaaacaatgtagattctgttgttttgggggtggagagttctgtagatgtctgtcaggtccatttgatccactgctgagttcaggtcctgaatatctctgtttgcctcaatgatctaatactgtcggcgggatgttaaagtctccccctattattgtgtggttgtctaagtctcttcgttggtctctcagaacacgctttatgaatccgggtgcttccatgttaggtgcatatatatttaggatagttaggtcttcatgctctttttttaattttttttttctttttctttttgattcagcagttgggctattacacactccttagcagattccgacttccgtggccactgtcctgctatggtcttcatgttgaattgaaccctttaccatgatttaatgcccttctttgccttttttgatctttgttggtataaagtctgttttgtctgaaattttaatagcagctcctgcatttttttttttttttggctttccatttgcttggtagatttttctccatttctttactttgagcctatggatgtcattgcatatgagatgggtttcttataggcagcataatgttgagtcttgcttttttttttttttttttttttgagatggagtctcactctgtcacccaggctggagtgcagtggtatgatcttgactcactgcaacttctgcctcccaggttcaaatgattctcctgcctcagcctcccaaatagctgggattacaggtgtgtaccaccacgcccagctattttttttttttattagagatgggatttcatcacattggccaggctaatgtcgaactcctgacctcaaatgatccacccacctcagcctcccaaagtgccagggttacaggcgtgagccactgcacctggcctcttgcttctttatccaacttgccactctctgcattttaattaggacaattagtccatttacattcaaagttagcatttacatgtgcagattttttcctgtcatcatgttgttagctggtttggttattatgcagacttgtttgtgtggttgttttatagtgtcactggtttatgtacgtaagtgtgttttctattggctggtgatggtcttttctttccatatttagcgttcctcttaggacctcttgtaaggcaggcctgatggtaataaattccctcagcatttgcttgtctgtaaaggatcttatttctccttcacttatgaaacttagtttggctgggaatgagattcttggttggaaattcttttcataagaacattaaatataggcccccaatctcttctggattgtagagtttctgctgaaaggtctgctgttagctcgatggcattccctttgtaggtgacctgccccttcttttttgctgccttttcacatttttttttttttttttgagactgagtcttgctctgttgcccaggctgccaggctggagtgcaatggcgtgatctcggctcactgcaagctccgcctcccggattcacgccattctcctgcctcagcctccccagtagctgggactacaggtgcccaccaccacgcccagctaattttttatatttttttagtagagatggggtttcaccatgttagccaggatggtctcaatctcctgacctcgtgatccgcccgccttggtctcccaaagtgctgggattacaggcgtgagccaccgcgcccggccgacatttctttctttcatttctaccttgaagaatctgatgattttgtgtcttggggatgctcttcttgtgtagtattttgcaggggttctctgtttcctgcatttgattcttggcctctctagtgacgttggggaagttttcatgaacaatacactgaaatatgttttccatgttccttgctttctccccatctctttcggggatgccaatgggctatttggtctcttttcatgatcccatatttcttagaggttttgttcattaatttttattctttttcttcatttttgtctgactgaattagttcagagagccagtattcatgctctgagattctttccttattttgctttattttgccattaatacttgtgatcgcattatgaaatctcgtagtgtgtttttcagctccatcagatccgtttggttctttcaaaatgaccatctcatagattagcccctctgtcattttattgtaatctttaggttccttgcattgggtttcaactttctcctgaatcttgatgaccttaatttctatccatattctgaattctatttctgtcatttcagccaggtaaagagcccttgctgggaagcttgtgtggtaatttggaggaaggaagacactgttgctttttgagttgatggagttcttgctcagttctttctcatccatgtgggctaatgttcctttgagtgtgctgcaatttgaatttttttcttttttcttttaaccgtgatgtaatttgagcacagtcagtagacttcttttctggatggtttcagagggctggggcttcgcacagggtctttatttatagctaaattcttgtccttggtttcacagggaggtatattagcgagcatttttggtgttgaagtttgggctgcaatccggtaaatgatgcttcagcacaacggccagtaggtcattcctcatgattgccgctgtgctccctctcacgctctgaaagtgcgggctcctctcccacccaagtgctggctgcagatctgggctcggcactcccaggctgcacatcacagctctggggtgagctcagactttatgttccctccgtggcttgggggcagcaggggaagggaccttagcagcggttgtggcagacggcctttcacttgtcccttggaactccaccccagagagatgtggagccactatcagtgcgatgagccaagagtgaggcgactgcactgtgggtccaagctaggggccctgcctagtgatgagcaggggggacaggtgggtcacaggggtgacagactggcctcttctccttagggcagtttgccggaggtgtggttgaagcactcagagtctttgctccttccccagtctgagggcagcaaggccagtaccaccgcagtggcagcggcagagtgaccttccgttgcctctgggagctccgccacagagaaacgcagactcacagctgctgggaacgctccgccagagggtggggctgttgtgccgcggaatcaagctggggcttgttgaagagcagggggttgagggctcacagggagaggagactgagctcctctccgtatggcgactgcggtgtgctggaagcatgaatgaaggccgggcgcggtggactcacgcccggaatcccagcactttgggaggccgaggcgggcggatcacgaggtcgggagatcgagaccatcctggctaatctggtgaaaccccgtctctactgaaaacacaaaaaatgagccgggcgtggtggcgggcgcctgtagtcccagctactcgggaggaggatgaggctgaggcaggagaatggtgtgaacccgggaggcgcagcttgcagtgagccgagatcgggccactgcactgcagcgtgggcgacagagcgagactccgtctcaaataaataaataaataaataaataaataaataaataaataaataaataaattgaagcatgaatgaaggccccaggctccttgcttcttccccagatcacgggcagcagaggcagaacccttgccatggcagtggcagaggggctgtcagttgcctctgggagccactccccagggaaacacgagccaccaccagtgagtgtgctgagggcggggcagctgctctgcactcccgagctgggggctctgcctggtaaagtgggggtgggagctcacggggaagagagactggactcctctctgtctgatggctgtggcataatgaccgggcccccacacatgaaaaagaattctgggaactcaaaaagccagtgtgtccccaccatggaccccttggattgtgtttcaaatttctcctcaatttcgaagagcgtcctggccatccagattctgaattctataaccctcgtttcattcatctcaatgtagctaagaaccagatttctggggaactatcgagttgccagagttcttgtgttgattcttttttttttttcttttttttttcttttttgtggcagagtcttactctgtcgcccaggctggagtgcagtggcacgatctcagctcactgctgcaaccttcacctcccgggttcaagcgattctcctgtctcagcctcctgagtagctgggattacaggtgtgtgccaccacgcccggctaatttttgtatgtttagtagagcccgggttttgtcacgttggtcaggctggtctcaaactcttgacctccggtgatctgcccacttcagcctcccaaagtgctgggattacaggtgtgagccaccgcgcccggccttggtgttgattctttctcttgtgtgagggctggtgttcctttaactgtgatgtcggttgagtacagtcgcttggcttcatttctgggtgttttcagatgccaggactctgcacaggatctttatttgtggctgaatttttcccttcattgtatactggcaaaatttttcagtgttgtattttgaagtgtgatccagtaggtggcacttaaaagggttggccagcatacaggatcttagccacaaggctcttttgtagttttgtttcgttttttgtttcgttttttgacacagggtcttgttctgtcgcccaggctggagcacagtggcacaatctcggctcactgcagcctctacctatcaggctaagtgatcctcctgcctcagcctcctgagtagctgggactacaagcacgcagcaccataaagagaaaatttttgtaattttttttttttttttgtagagatggggtttcaccatgtttaccaggctggtctcaaactcctgggctcaagcaatctgcctgccttggccccctaactcttgtattttgacaaagtcggcagtagtgctctgtggttgtgaggaggggtgactccctcgcctggtccattcttgggccttggaggagcctcctacagtcactggctctgcacccactgtttcctttgttaggattgttctgcccacggggctccctcaggcagggcatggtgggcagacaggctgtatccttccccggccagccctatggagggaggaccaccccgcacctctgcaggctgatgaaatcaggtgtttcacccctctgaacgttctgagaatgagggctcctcacggcttggtcgccacctaacgtggtgagtccttctcagcaagggtgattggagccacatgatctgccatctcagtgcttcccaggggaacacagagctactgggcatggtggctcacacgtgtaatcccagtactttaggaggccgagatgggcagattgcgaagtcaggagactgagaccatcctggataacatggtgaaaccccgtctctactaaaaatacaaaaaaaaattagccaggcgtggtggcgggcgcctgtagtcccagctactcgggaggctgaggcagaagaatggtgtgaacccgggaggcggagcttgcagtgagccaagatcacaccactgcactccagcctgggcaacagagtgagacttcatctcaacaaaaaaagaaaagaaaagaaaaacacagagctgcacaccccacagagttcaggcagaagggggtctgcagcgctggaagacccagcaagcctggcccgtctggctgcaagtggcaggggtgggtggagtcacccacttcaccatctgggtgctttccagggaagcatgcagccacgaccccgggcagagttcaggcagaagctgggccactatgctggaaactggccttgagccttgtggagtaacggcaggtggagccatctcactgctcccacgcaccatgcccgtggcctctgcgggggctgtggtaacggcacccgactgctctggggtcaatgcctgcggaggtccccctggcttcagtgttgcctctgcaaaaaccccagttgcagccaggtgcggtggctcacgcttgtaatcccagcactttgggaggccgaggcaggtggatcacttgaagtcaggagttcaagaccagcctggccaacatggtgaaaccccgtttctactaaaaatacaaaaattatccaggcatggtggtgggcacctgtaatcccagctactcggaaggctgaggcagcagaattgcttgaacccgggaggcggaggagctgagattgcaccactgcactgcagcctgggcgacaaaacaagactctgtctcgaaaaataataacaataaaaaataaagatggcaaccatagacactggagactactagatgggggggaagaaagggggttgaaaaactgcctattgggtactatgctcagtacctgggtgacaggatcaatcgtactccaaacctcagcatcacaaattatttaaatttttctctttttttaatttttttgttgttgttgttgagacgaagtctcactctgttgcccaggctggagtgcagtggtgtgatctcggctcactgcaagctctgcctcccaggttcacgccattctcctgccccaatctcccgagtagctgggactacacgcgcccgccaccacgtcctgctaattttttgtattttcagtagacacggggtttcaccgtgttagccaggatggtcttgatatcgtcaccttgtgatccacccgcctcggcctcccaaagtgctgggaatacaggcgtgagctaccgcacccggcctaaatttttttttaaataaagaatggtaggttcttcacaccctaatgtatttttacttctcccacagagaaggaaaggaatggcttccccatggcaagccacctcagtctgggctttcttttcttccaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacaggttccggtacagtgacaccctggagctggtagtgacaggtaaggaaacatccagggtccacagccctggtgtgatttttttcttatttttaatagagtatttttcaagaagttttagatttacaaacaaaaaaaaattgatgattgcttcagagagttctcagccatctggcaccccacttcccccagagttaacatcttacattagtatggcacatttcttaccattaatgaacaaatatcgacacattcccagctacagtctacagtttatttacattttcttagtttttacctgatagtctttctctgttccaggatcccattcaagatttcacattgcggctgggagtggtggctcacgcctgtaatcccaacacttagggaagccgaggcgggtggatcacccaaggtcaggagttcgagaccagcctggccaacatggtgaattccccgtctctactgaaaatgcaacaatcgctgggcgcggtggctcacgcctgtaatcccaacactttgggtggctgaggtgggtggatcacctgaggtcaggagttcgagaccagcctggccaacacagtgaaacctcgtctctactaaaaatggaaaaaattggccaggcctggtggcacacgcctgtaatcccagctacttgggaggctgaggcaggagaatcgcttgaacccaggaggcagaggttgcagtgagccaagatcacaccactgcactccaggctgggcgacagggcgagactccatctcacacacacacacacaaaaagatttcacattgcattcaggtgtcatgtatctttatttttttttttttttttttttttgagatggagtcccgctgtgttgcccaggctggagtgcagtggcacaatctcggctcactgcaagctccaacctcccgggttcacgccattctcctgcctcagcctcccgagtagctgggactacaggcgcccgccaccacgcctggctaattttttgtatttttagtagagatagggtttcactgtgttagccaggatggtctcaatcttctgacctcgtgatccgcccgcctggcctcccaaagtgctgggattactggcgtgagccaccacgcccggcccccgaaaatgctgggattacaggcatgagccaccgcacctggcctcccaaagtgctgggattccaggcgtgagccaccgtgcccggcaggtgtcatgtatctttaggtttgtcttggctgtcacagcttctcagatgttgctggttttccatgaccttgtcagttttgagggtagtggtccattattttcaagggtactcccactactggaaattgtccgatgttttgctcatgactagactgagttatgggtcattgcaggcaagaccacagaagcaaagtgccatttcatctcctcatagcaaaggtttaaactgtccatgggaacatgactgtggatgttgagctggctgttgttgaaagcctggctgaagtagtaactgtggccagacaccgtggctcgtgcctgtaatcccagcactttgggaggctgggcgccgtggctcacgcctgtaatcccagcactttgagaagccgagatgggcagatcacttaagcccaggagaccagcctgggcaacatagtaagaccccatctgtacaaaaaatcaaaaaattagctgggcatggtggcacccacctgtagtctcagttacttgagaggctgagatggtaggatcacctgagcctgggaggtcgaggctgcagtgagccgtgattatgccactgccctcagcctgggcgacagagtgagaccctctctaaaataaataaattctaaaaaagaaaaaagaggctgggcactgtggttcacgcctgtaatcccagcactttgggaggctgaggcaggtggatcacctgaggtcagggattcaagaccagcctgaccaacatggagaaacctcatctttactaaaaatacaaaaattagctgggcgtggtggcgggtgcctgtaatcccagctactcgggaggctgaggcaggagactcacttgaacctcggaggtggaggttgcagtgagctgagatcgtgccactgcactgcagcctcagtgacagagtgagactccatctcaaaaaacaataataggctgggcacagttgctcatgcctgtaatcccagcactttgggaggccaaggtgggcaaatcacctgaggtcaggagttcgagaccagcctgaccaacatggagagaccccgtctctactaaaaatacaaaaattagctgggcgtggtggtacgcacctgtaatcccagtttctcgggaggctgaggcaggagaattgcttgaacccgggagacggaggttgcagtgagctgagatcacgccactgcactccagcttgggcaataagagcgaaactccatctcaaaaaaatatataataataacaataataagaagaagaaaagaataaaggagaaaaggtctttctaatagctcactcttttctctcttaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacaggtaggtaccgcccagtccagccctgtgtctgggttggctgtccagggccttgccaccgggcaggaatatgaagacgtgcactgagagtgaagtgaagagaggcaaaggctctcactccaggacagtggagagagaaaggcttccccaccacactttccgctttcacttcctcgctagagttctccagacagggttcattgaaaacttagtctgtggagaacagaagggctaactcagtttgtttcattttatttatttcattttattttccgggatagagtcttgctctttcgccaaggctggagtgcagtggcacgatctcgactcactgcaaccttcgcctcccaggttcaagcaattctcctgcctcagcctcctgagtagctgggaccacacagacagggtttcaccatgttggccaggctggtctcgaactcccgacctcaggtgatccacctgcctcggcctcccaaagtgctgggattacaggcgtgagccaccgcgcctggccaggctgcacacattcttattaggattccaccttgttctggtgttgtagagatgtgattaggtatttagtgaattcaccaagtgaggagagaatgaaaagaaaacacaacctgcctggccgggcgtggtggcgtgagcctgtcgtcccagctactcaggaggctgaggcaggagaatcacttgaacccaggaggcagctgttgcagtgagccaagatcacgccattgcactccagcctgggtgacagaacgagactccacctcaagaaaaaaaaaaaaaacatggttgggcacgatggctcacgcctgtaatctgagcacattgggaggctgaggcaggtggatcacctgaggtcgggagttcgagaccagcctggccaacatagtgaaaccccatctccactaaaaatacaaaaattaaccaggcgtggtggtggtgggcgcctgtaatcccagctacttgggaggctgaggcaggagaatcacttgaccagggaggcggaggttgcagtgagccgagatcacgccactgcactccagcctgggcaacagagtgagactccatctcaaaaaaaaaaaaaaaaaaaaacacacacaacctgcccataatcacctccttcccagtttatagcacttccctgggaagcacagttccttgcccgtgaacacagtcttgctgactgatcagtgtggtgctggcgaagcatgagctcattgaggggatgcttgagggagtcccattttggcaagcgaaaaggaaaatgagctcccgtttcagggctctggggttgggatggaatggaacacaaccaccaaccattcatctccttgaattgtgtctccagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggagccaggactgtggagtccgacaaagctacttgaaggacacaagagagaaaagctcactaagaagcttgaatctacttttttttttttttgagacagagtctggctctgtcacccaggctggagtgcagtggagcaatctcggctcattgaacctcttgggttcaagtgattcttgtgcctcagcctcccaagtagctggaattacaggcacataccactgcacccagctaatttttgtatttttagtagagatggggtttcactgtgttggccaggctggtctcgaactcctgacctcaggtgatccacccaccttggcctcccaaagtgctgagattataggcatgagccaccacgcctggccagatgcatgttcaaaccaatcaaatggtgttttcttatgcaggactgatcgatttgcacccacctttctgcacataagttatggttttccatcttatctgtcttctgattttttatatcctgtttaatttcttccttcattgttcttctctttttttatttattttatttatttttatttttatttttatttgagacagagtctcactctgttgcccaggctggagtgcagtggcacgatctcggctcactgcaacctctgcctcctgggttcaagtgattctcctgcctcggcctcccaagtagctgggattgcaggctcccaccatcacgcccagctacttttacagtatttttagtagagacggggtttcatcacattggccaagctggtctcaaacttctgacctcgtgatctgcccgcctcggcctcccaaagtgctgggattacagatgtgagccactgcgcccagccttctttttatatttttaaatgtgtcttccccaaatataaatggttggtaagcatgccaaatatattcaataacccccctcctttatttttttttgttgaagtgaggctctccctatgttgcctaagctggtcttgaactcctggtctcaagcaatcctcctacctcagcctcctgctgtgttcatctacaaattgataagagtgaaagtcataatcctacaggaggattaccctatttatttcacaaaccctatttctaccggattttcatacaaggaatacaggcatgtgtttcacctcattaatttattttttcacttagttttgatgatattcacatatattatcaagtgtgcaaacattaaattcttgtgtacaaaactcaaatggtcttccaaataattccccattcttttttcttataaactttcacagctttacccttgacagactttactcaaggaaatctaagttggtcatatgtggctctttcactgattgctatttacttcattgtccagtagcttatgtatgaaaatataattataaaatgtaagggtcctacttccagtgaaactgaagggacttaggcccacttttatcctttactgagagcttatctctacttgataaaatttctactgtattcttggcttaactcaggtcctgtgattaaaaaaaaaatgcaaagta

SEQ ID NO: 30 - DNA, 45779 bp, Homo sapiens
acttccttcttttccttcacctcggcccggctctgaaaggatcgggcccctccggcccgcacccacccccaagaggggccttcagctttggggctcagaggcacgacctcctggggagggttaaaaggcagacgcccccccgccccccgcgcccccgcgccccgactccttcgccgcctccagcctctcgccagtgggaagcggggagcagccgcgcggccggagtccggaggcgaggggaggtcggccgcaacttccccggtccaccttaagaggacgatgtagccagctcgcagcgctgaccttagaaaaacaagtttgcgcaaagtggagcggggacccggcctctgggcagccccggcggcgcttccagtgccttccagccctcgcgggcggcgcaggtccgggcccggcagggacggggaggggcagagcgggaccggtcggggctggggaccagccgcgcgggcttctgaacgggcacgctgtcggagccggaggctcgtctagtcccgagccccagcgggccgcggcggctcgcggggccgccttcccgggacagcagccggggcccgggcgccggcgcgggggaggacgctgccctccccggccgggcgcgcagctcgcagccctcgctccctcccccggggcgcgcaggcgggcgctcgctcgcagagaaggtgccggcggggccggagccccgaagcctccccgggcggcgggaagacgggaggaggggaaagggaaggagggagggggtcgggctgccgggagggcgggggcagcggccgggactgcgggccgggagcgagcccagccgcccgcgccgtgtggagcccgggcggggcaggtgggcagcggcgggggcggctccgcgcggccgggctcggccgtgctgcccctcgcccctgctcgcgcggtcctctctcccgcgcggtctgtcggtctgcgcgccgcctcgctcctcgctcctcgctctccccctctttctccccctctcgcctctccgtgtctctggctctctgcctggctcccttgggtctgtttctctctcctgccgcctctctctggccgcccctggctttatttctcgcgcgcttggggtctctcccagtctccgtctctccatttctcctggggggcggggagggggggtctccaaaaaccgcggcggcggcggcggccgctccaggcgcccgttccggagtcggggggaggcccagccgggaggggggaagggggggagccttagtcatttccccgctccagcctgctcccgcccgagcgcgcactcacggccgctctccctcctcgctccgcagccgcggcccatggagcccgccggcccggcccccggccgcctcgggccgctgctctgcctgctgctcgccgcgtcctgcgcctggtcaggtaagcacccccccgctccccaccgctgcactccccaaactgcgggctcaggcctctcagactggcactgggaccccttcggctaatgccgagcagtaatagggggagagacgcctgtaaccagggttatagatgcagaaactgaggcccagagagggccagcgacatgcccaaggtcacacagccaagggtagaacccaagtctcttctatgagagtttgtctctgtggactctgactctgtgcactgtgctgggcactgagacaaaagagccgagttgcttcactcagcccctgcccggtccaatggggaaggctgactgacagtggctttcagagcagggccgtccggcttccccagaatctgtccccatggacatacgactttccacatgtttgacttcagggtgtgaggggaggaggtgagggcagaggtcctcccgatgctgcctggaatggaacagagacaagctgttgcaattagggaagagtgagccctccctctggtgcgcagagtaaaccggtgttagtgtgtgcctgggagagagggagccgggaggccgcggtaaccccagagcgagctgctgcgagcaacagatccttatgtaaaaacacggtggattgtccctgtggttgccaaagcctctccctggtggtcttgctccttgaggcgctcccagctcccccttcctcctgccttccccgagcttccaggcagctccctgcagttcaggtgctccgcggggatgttacctgtggctctgaccatgtctttctgttggcctacatcaaacacctggctgtcgccggcaggcgggctctgaaggctactgtgcatgttcaccaaagggtgaggtcaccattcaggagtcttgcttcttaaatgggttttgcaaaaccatgggtctcctgggagggcaccgggtggggggcggggggagcagagaaatggcattaagggagttgggagggagagaaaaatggggatcttgttttttgtcgtcttgaaactgtgttgtaggcagtggggtctctctgtacctcccacccttgaggagggaggtaaagatgagctcagtgtccaacacccccttttgcgtttgactagagatggtaaccatctgatagcagggagaaagggagaactagcaaagagtgggtggaaggagaagtatggggggtagacagctgcttctctctgccctgcagtttcccctgaaacccaggaattcacataggcatccccccaccccaccccaccctccacccccagttcttttcagttatagttgcgtccttgctgggctgaagggagcactgatacagttcacgtctctccagtgagtggcatctcctatctgctccttcctgcctgagctggccatttgtaccctgcaaaagtccgagttcctgccctgccatccttcctggcctggaaatgcacaagtgtcactcacaagtgcttaattttcctgaagcagggaattgggcccgagttaatttctaaatgtctattccagacccttctccgaccaggaggctgtggttcagtccctggcaaacgagcagtgacgctgattagcaagtgctccgatgggcagcctgcctttcctggggcaccggctgggaacaccaacacctttcttgtgagcacatctcccccttttgcctataaaaacagtctataagatggtaaagattgggccataaaacttccgttccaatccattcagcatcaatagcctgaaaaagtgggagcagcagaggggccaagattagctttgaaataaataaatcttaggaggtaagaatgaatttcttggtcgagggtggtggggaagggatgaggtgcgaccatcatagctcaagtctcccattatccttcagtatctgttcttcggggtcctggtcacaccatgggcctgggcagggaagtcacctggtttggctgaaggatggggcctcaggcccctccccctattgctccagacatggaatttacaacaaagaagtagagagacaggatatgagggtaggaaggtacaaggaggcagttgtccaattttctaagaaaatggatttgttcgagtgagaaactaaaatgtcaggtttaggaaggcggctttggattgaatgactactagtgtctcaggcagaactgtcagcctgggaggtgtcacatgattcctgtgtcttcacatgatcactgttttgggggggtggggccaatcatgtgaattatcctgggtgggggaggcaagagaagaagtttctaaagattgcttttagcacaaatgctgccaaagggaaattctaaaaagatcccagtgaagtcaccaacctatgtttttggacccaatgtgaggcctgtttcctaaaacaactgcactgagggagattctgaggctgggagaagggcaagggactgaggcctggggacacctggcacctgattttgtgtcagcagggcctgacgctgaacccgcaggatgcctgcttggccccaggtaggccttgagacctctgagtcaccccccaggccgacctcagataaactcccattcatttcttctctctggcctggaggaggccaagccaagttgcagttcaggctctggggagcagcggggccccccagtgaacctctcaccgtttggtagagggtggcactctgggggctcctctgtactttcctaaatggtaaagttaatctcacttcctctttcgtaagaagagaaaacggggcgggagtgctttggctcaacacatcaggctgttggaagttcctttaaagccatagttttctctgagtactttctggcctttaccaacccctcggaaactcacggtaattcacgtctgtacttgcagtcatgcagcacctatgcagtgctggtgtgaaccatgtgttgagagaagggaggaaaaccaacattcattagatagttaatggcgttccaggccggatgctgctcctgcgtcgtctcacccgcaagacatggattggctcttctccccattctgcagatgcagaaaatcgagtcccaaactggggaactaacttataagtgatagagaggagccaggattttggatgctggccttcctgctgggtggcttctagggaagaagctcaatgacttaatcaggatgatttagtccaagctggagagggagtgagagaggcccctttctggccttgggtggaggactgtagaagagttctttctctgggcagaaggttttgatgaagtcacaggcatttctctgaaagcctgctgagggtggaaatactgacagccccttggtcctcaccagtaacaacacatgagaggtgatgtggctcctgtgagagccccccatctgggctgctgagctctggagcccccagagctggaatattcctccctgcatcttcctggtgccctttgcgacagatggagagggggtgtgcgagaggaagggagtctaaaagtgttgtacggatcccacacgcgctcgcttgctgcttccaatggctccgtgcgacaggttattttcttatttgtagtcttggactgacggaaggtttcccccctctctctctctttttaaatgtgctcagatttctggcctgtcaacacaactcagatcatgtcactccccagctcaaaactgttgagtgggtccaagttttctttaaaaaaaaaaaacaaaaaaacacaaagctgccgtgaggcctgggcttcctccctgccaggcctgatttccagccacatgttttccaacaagctgacctgttgagatgctgcaggataaccaggcttcctccctgcagaccagagctttgctggctactcagccacacgagcaccccaaagaccctgagaagccctgcaatgtagaatcccgagctgggtcacatttactccagtgttccctgaacttatgaacgagaggcatttgatttgtagtatgcccgttagcatgtggcctctctccgtttggtaaacggttttctacagatccatgccctcagctgaactctcagctctgtgccttggcccgtgctgttcctgccatcagaaatgccctccctgtacctccttgtcttcctgtgtctgaatcctactcatcctccgaggttcaatttaatgtgcctcctggggagaggtcagaggagcctctccacgcagacacacaccctggcctagcgctaagatggtgctaagacccctgggtgttgatctgagccctgctactgacttggacaatttgcaggaatctgtgtctcattttgctcatctgtaaaagaggaatggtattaaccactctattgcaaggattaagttaattaatgcgtgtataatgctggaagccatgccttgtatgtagtaagcactcaatacatattaaccagtgttgtaattagcatggctttattctggtttgattcctcttttttaacaattgggacggattttcataaaacatctaacacagttgcttacacatagggggtacttaaaaaacagcaaaggctgttcagtgaacaaatgtccttcagcttgatattttccttgtagctttttttttttcttttttttttttttgagatggagtttcactcttgttgcccaggctggagtgcaatggcgtgatctcggctcaacgcaacctccgcctcctgggttcaagcgattctcctgcctcagcctcccgagtagctgggattacagggatgcgccaccatgcctggctgattttgtatttttagtagagacaaggtttctccgtgttggtcaggctggtctcgaactcctgaccccaggtgatccacctcccaaagtgctgggattacaggctgagccaccgcaccacccagctgtccttgtagcttttatgctgttgggggatggacaagttgagtagaaacccaggctagagtgatttaattgcctgttactagggactgagtgctgtgggcacagcctgcctctaggtgtctctatctggatccacaggtctgcagttgtggattcccggacctgcaaagcagtagggggcctgagagagccctctgtgctttcatccagtgccttatggtgcggccagaagaacagagagaaaaaaactggccgggcccacgcgggagatccatggcaaggcccggctggaacgccaagcctcctgtggtccaggccaaggcttttaaaaactgggctgtgctggaactttccactgtttcagccagaaatctgacaggatcccgaattccccgggaaaacactaaagtaatactaataggaaccatctgggttctctgcttcctgggctcagcacttggtgtgtgtgaccctggtggtactcacagccacctggcgatgcacgtcgttatcttcggacccgttggatctgtgaggaaactgaggctctgaatggtgaagcagcttgcccaaggccacaccgtaagcgccagatgtggataaccactgtcggcctaatcacagagcctatgtggttaactgttgtgccattccttagccgtcactgaggcttgcttgacaggtagggaaactgaggcccagttgtgctggcaccctgctcccttagtgctcctctcatttttgtttttgttttttcttcctttctttctttctttttttttttttttttttttttttgagacggagtcttgctctgtcgcccaggctggagtgcagtggtgcgacctcggctcactgcagcctctgcctcctgggtccaagcaattctcctatctcagcctccccagtagctaggactacaggcgcacaccgtcacgcccagctaatttttgtgtttttagtagagactgggtttcaccatattgatcaggctggtctcaaactcctgacctcaggtgatcctcccgcctcggcctcccaaagtgctgggattacaggcgtgagccactgcacccggcctcctctcgtatttctatcagtgcaccttcctatgaggtgggggcagtgtgtgtccccaaggtgtgtccctgtccccatactagagaaggaagcatctattttcacagctgaaactgctttcctgttaactgctggtgttcctgggatgggtattctgatgaagccctccacgagatggattttccctgccaggtgtcttgccaggccctcagtccagagagatgcaaaacagctgaggtggaagtcggaaatgctgcagaattggttctttgtgtctgtaagatttcctggcacattcgttcgggggcgcagggtgttagatggctgcagattagcgccaagagcccaaggagatcaggtgctcggatcaggagggaaattggaagccgggagtgagcgatgggcctcccagccaggagggacggctggagcaggtgggcggtgataccagcgccgtttctacagctccattcttcaggccgaccgtcggtgttctccagaaatggaagcccgtggtggaaggaaatactaggtacacgatgtgctcggcacaggctgagccttgaacatgtgttagctcttccttatctttttattttggaaaatttcaaacatatgcaaaatgagaaggaatgatgtaatgagcctcagctttgacactgatcaactctataccatgcttgtcccctgcccctatttttgctagggagaggagaatcggggagtatataaagcaagtgctaaacatggggtatcatttcacccaccgatactctctccacatcccttcatgtgagctgttacctgaccctcaccacgagccaaacagtatggcccttcatccccactttacagataaggcaactgaggcttcccaaggccaagtggggctcatccttaggccacacagccagtgagaggtaaagccaggctccactcctcactttacccttaaccactttgcagtcattattagggtcattttaattgtaaatattcattcaacaaatatttttgagcacctactatgtgccagggatggctctaggtgcttggaggatacaaatgtgaacaagacagacaaaaacacctgctctcgtgcagcagacattctagtgaggaagagaaaaacacacccaagtaaacaaatgatgccaggtagctggggagaaaagcaggaggagggaagggagaaggttagtcaggacagagggagggccgctctaaggagcagaggcctcaagaaaatgtacaattaaggccaggtgcggtggctcacgcctataatcccagcactttgggaggctgaggtgggcagatcacctgaggtcaggagtttgagaccagcctggccaacatggcgaaatcccatctccactaaaaatacaaaaattagccgggcatggtggcgtgcgcctggaatcccagctactctggaggctgcggcaggagaatcgcttgaccccaggaggcagaggttgcagtgagccgagattgcaccactgcactcccgcctgggtgacagagcaagactctgtctcaaaaaaaaaaaaaaaaaaaaagaaaagaaagaaaagaaaatggaggagtagccacgggggatagcaagagccctccatgtgggaggaatggcagatgcaaaggccctgaggcaggaatgagcttgtatgttccaggaattgcaaagaggccagtggggctggagtgaaagtagaagaggtgggggagtgagcagaggtcagggccagaccagcaggatctggctcattgagcacctaacatggagcatgtctggcttgtgagaggatcattatgcattctctcatttaattctcaccacgggttctgtaagatgggaaataccgttaatccattggacagatgaagaaactgagactcagaaaggtaaagtgacttgcctaaggtcacacagcttttatgtgcagaactaggatttaggtccctgaatgctgcagcatccccattgctgctttccgcagccgtccttgcccccttcgggctcttcacccatagcagctggagtgaatcaagtcatctttggttctgctggaaacctttttcggtttccagcatggcatttctggaccacgtctgtctcttcatcctcacctcttaccactctcctgcctccttgggcttcagccttggcagcgtcctttctggcccttcaccagcttctttcccacccgagggcctttgcactggctgtctcttctacgggagcatcttccctggtcttcacttcctttgggtctcagctgccacctcccttccttggatgctgtcccaaccaccccattccaaaagaggttatcgcttgtgattctctatcactgggccaaatctgcctgttgcctagtgctcctagccctttctatattaattcatttcattatttcagccctgtctcctccactaggatataagctgcacgagagatgggctatgtctcttactcactgttgggcctcccaggacctcagcacagggcctgacacacagtaggtgggttaatagatactgattgaatgaaagaacaaggtgggtactaaaatcccccttttaaagaggaggcttggagttatgaggttgtacgagcaaagcttattccctaactaccacagtcccccccctgcagccagggccgggatcataccacaattccctgcccatcaagctgtcatgaatagccctaagatatcaggaagcacaaagatatcaatgccaggagggataggaggaggcggccaagaaaccccggaatttgtacttaaaattctggctacgcaaactgcttgcccaactttagacaccatgatgaatgatcaggtgctgcaaccatgaaacatgacgtaattagtgctgcactcttggctgggggttggcttggaggccccacctcgaggttagcctcccccagagggtcactgcacgaggcagtctggtgcggggtgggggttacaacagagggaggtggaatcagaccactcggcagccctgtgaccatggccaaatggttgtacctcccaaagcttcacatctggtcctccgtgaaatgggggtggcgacagccctgtcttactgggctcctgcagaggttccatgaggcctgtcttgctctgggcagcgtcgatgcttattagctattgttactgctgttatgtgattgtcatcgttttatggtttgggaattttaaaagctccatcttttgccagcggggagacctggaacccactcctctgccccctcagcctcagtttccccttctgtgaccgggaggcttggctcggctcctctcttgcaggtcccttccagccctgatgctccagcctgcatgtcctcctggccctttgtcctgatgactccacagactcctctgggaggagaggccatggaggggcttctgctctggggcacattcctgaattggagtccagcatgtgccgcttactggctgtgtgctctggggcaggtgtcttcccagctctgagcctccgtttccccatctgcaaaatggaaccgctaacactgtttcctcccaaatgggtgactgttgagggttaaggaattaagagccgtggaaagtgcttttgcaagctgcaaaatgctctataaaaggaatcagtgaatagtgtcagcttggggaaaaatcccgtcagtccggagactgtctgctgccggcagtgtgctgaaaccctggcaaatgtcgtttaataaatgcgtgttgcttttaagagggcctttatctcagctgggaaaatgtgtgcgcatccttggcaacctgagaatccagaagcctgaactggaggggacctgtcacagggagaggcgatcgcatggggtggctccagcctccagtgttggaatcccacctctgccacttacctacctctccagactctgcttcctcatctgtaggaggggacagtgacaatagcacctgccactctgggccaggatgtcctgagggctaaatgaaggcttctggttatctggcctaacccatgcatttcccccatgaaagtgtggctgtgcagcaccagggcctgtctcagggcaatggttggggcctggagattgggaggacctcccaacctcagcctctccaggccttactccaggcctcagtttcttcctctgcaaaatgaggaggaggaaaggtccttaggttgtcaaggcaccaagcctagtagatgtcaatgtcctctacctgctctctcagcctctgccggtcccccgaagcctgttaattctaaaggatatttacacagatttgcagttcttttcctgccactttgcaaacagggtcacactgcaagcatcgcttcatcacctccaggtttcatctgaacccagcaaatgctccatagggctcccagtgccgcctgtccccgctgcctccttgccagcagtgtgctcagcctgcttacaggcccatgccagaggggcctcatgcatgcatcaaggcagagctggttctgcctcggagaggatcccgagcctctcaggcttaaggacgtggtcatctgtcgcccccttcatctttagacacccatctgcatggtgacagctgctctgcattgagtacttactctgtgccaggcacgctagcccgtttcatcctcagaacaaccctagtattgttatcatcatcatcatcatcagacccattctacagataaagagccagaggtccagagtgggcgagacattccctggagtctcatgggtagcagagttggaatccaaatcaaaacatactttcagccagtgccaggcactgctccaaccctggggaagaaaactcagttcctgctctcaaaggacttataagtgagtctatgacagggagatgagcgcttttaaaaaattaacaaggaaatgcgtagctttttgagtgaggatgacatatcgaacaatgaagcagagccagggacattgaggtgggtagtattttagacagaatggccaaggaaggcctctcagataggcctgaaggagaggagcgagccagacatgtagatatttagggatgagagtgccaggcagaggcaatggcgagtgcaaaggtcatgtggtgagtggagaatctggcacgattgggggaaagcaaggctgtaggcccctggggccactgtaaaaattctgggtttcactctgagtgcagtgggggctgtgggagggttttgcacaaaggaggaacgtcacctgacttaggttttagaggcttctctggctgctgggggaatgtggctggtagagaggtgaggcagaggcagggaggtcagcgtggaggttcagtcagggtggtaagaagaggtcagggtctggccatgtgttggaagttgagccagcaggatctactaacagatgggttgtggaacacggatgaaagggagtcaaggaaatgtctcattctgagtccagcacttctaaccacagagcctctgacctggggagggagggggctgcatttcctgtttacaggtgaggaaacaggcttagagaaaagcaactttgccaagcaccgtgctacagacaagacataaaggtcatctggccccagaacctgagctctggacagtcttagcaccttagaagtttacctactgcatggatggggccaccagagtctgccccttccctgcagggatgtggcacagcactgagttctcagagctacccagggcaagggtgaaggagtggggaccctgagcccctgggccagctgtcagcttatttaccaggccacacgcatccccatttttggtggcttcaatgcaggtagcagtttctatcacagcacctggtttgtccctgcccaatgggtgtatccagtggtgccggcagaatgttcccagtgctggcctgctcttcagatgggcaaccgaaaccatccttcagggcgctaggttagcccagtcccaggtcctccccatctcagcttccttacagccagtgagcatgttccaaggactctaccctgagtcctgtcacctctgcgtctttgctcatgtggttccctcctcttggaatgccttccttcatcccagcctctgtcagcctttaagacctagctcaggggccaccagctccaggaagtcttcctgggtttcactctcttccagaaccccatccctaaacctcctcttgcaacaccgatcgccatgtgcgtggtcattgctcatgtccaggacggccccacatgctaagatagtctcaagggcaagggcctgtcttacttggctctgttttctgtggtatctaggacagggcctggcagcagagtgaggtttgagagggcatgaatgaatcattctgactccagaggaaatcactgtgtagtcctggctgttggagccccaagctctcttcttgggaactgtggcatccatgcagccatccactggtgcagccccggccatgaatgcagccccagctacctttcgccttcctgcatggggtcatgggctccagcagatggttctgggctagcctgttgacagctgtgccctgtggccagcacatagtaagtaggtgctctggaaaggttagcacctcctatcaagggcacgaccctagacagataccacacagggtgttgaccgccaggagcccatggcagacttgagggaagtgtgtctcctcacatcctccatcacccttgtgcttgtggaaacttacacagcaacctcatctattccaggcacatgcccagctggacacactcccgaacacaggcacacggacacctggggtgcacacaaatagtggcatgtgcatacctccctgcttgtcaatgcacacaccctcatagtcacatttacgcatacagcactctgtcacacacgtgccaccccccacacacaccctctacacacacatacacaccacactcacgtgcatgccgctcctgcatcactctcccacacactcacaccctcccacacatgcccaggccaccatgattcagacactctcctgcacacaattcacatgcccacgcccatgatccctagccccccattcagacacagtcctgtgttgcactctgacatattccggcacacaggcaccgtctctttcacactcctccttgtgcccacccatgtgtacatgtgtgtgcagatgcttatgctctgtacacgcatacatgtatgtacacacgtgtgttctcgtgtgcatactcttatgcaccctcagcacactcatgttcacatgttccattgtacagccctgtactacatcctgtgtgcatccgctttaatgtacactcatgttcacgtgttctattgcacagccctgtactatatcctgtgtacatcctctttaatgcactcttaatgttcacatgttctctgcatagccctttattacatcctgtttgcatccgccttaatgcacatttatgttcacatgtgctattgcaaggtcctgtactacatcctgtgagcaccctctttaatgcacactcttgcactgcatactctggcacacagcattaaatcacacccagaagatagtagaggcagcccccgatgaggagctgctataagtgcggggtggaaaatcgcagccttctgaggatggtgaataacaataatgatgagggaagaagggagccgggtatcactgcagccactttagaatgttgagccctgtgtactgccagagctccagccatagcctcccagaccctgggggtccttgagtacaaacaaagaatctacaaagaatccaaacaggtggcctcctgcctgtccctgtggcttgtgctgtggtgacccactgcttccgggggatgggcaagctcccatgcagtggcagtgagcacccgcctgggcaaggctggttcttgggaaatgtgcctgttggcttccttctccccaccccttgagacaggcttctggaagactcacaccccagggtaaggcagccctccccatccccgcctcaagcttcagttctaagttgatttttttttctattagaaaaaacatccatgtgggcagggcgcagtggctcatgcctgtaatcccagcactttgggaggctgaggcgggcagatcgcctgaggtcaggagtttgagaccagcctggccaacatggtgaaactccatctctactaaaaatacaaaaattagccaggtgtggtggcaggcgcctgcaaccccagctacttgggaggctgaggcaggagaattgcttgaacccgggaggtggaggttgcagtgagccgagattgtgccattgcactccagcctgggtgatgagagtgagacttcgtctcaaaagaaaaaaaaagtatccatgctaatttttttcaccctttatgaaatattttcatcttttaatctcaaaagccacacacatgaacattgttttttaagaaatcaaatatattttctaaatcccagtggtcagttctcagcccccatcttattgcatctctcagtggcattcaatgcaggtggtcacaccctccttggccaattcaaagaagagaaaggagatgtggcgggagaagcaggtcacaggaaggggccgggagatgggatctaagatgccagcaggagcctcttgcccaggggggttaggtacattccagatgtaatcatttgagtgatttctttgaaatccatctttgcctcgagggtggaagctccatgaggccagggacacagccatttcacagcccttagctcagggcctggcacagggaaggatccagaatgcagcactgaccgcacttgctgtggacactgagttcctcttacagcaaacatatggtgaccacccactgtgctgactgctccccttaggaaacgtgttcgtgtgttttgtttcattactttttaacttttttccaaaaccaataaatgttcactgcaaaaaaatacaatatatgatgtattataaagtaataagaaaacatgccgaccccatcctacctcagtcccatttcccagatgcaacacaccacagcatgccatgtttaacttatcatccttgcagacctttttctctagacatgcgattgaccaatcaacaaagatttatcgagcgtctacactgtgccaaccacagtagcaggagctggggaaacagtgaacaaaacagactaaatccctggaggagaggttcatttaaacagtacacatacggtaacatacatcattacatgtacaggttttttaaaaaacaaaatgagatactataaatattcttttgtgttcatccaatttagagaagctgaaacaatgcccaaagtaggaggggaaaaaaagagaaaaacctcatgaggtttagattcatgatccaaagagagttacattttatagctttgtttaataccctccagttgtttatatatagttttattttacaaagtcatgatcatacagagggtatagatttttctccatctttttttttcttacaaaagaaatgcaaacagaaaacataaacaagagcaaaatcccatgtaaatctaccactcaatcatggctaatctttaatatcattgtttttttctaaaattgggagtttgggatcacactggatctactacttggtaacagactctgatcttgtaacacatttccattgtaattctataccatcattttcatggctatagacttggcctatagctgtgaaagtagattcaccataatgggatcagccaatctcctttccttggatattaggatattttcaattttttattttcatacagacacttaagtgaatgaagcaaaatgtctgcacatattcttagttacctaaaggtatgatgttagattgtttttcttcactcatatttttactacatcagaatgttgattacagttatctttgatggtatgatgtgagattattactttgtttccatacttattttctctaaatgccttgcaatgaacaggttttatttgcataaacacaatattatttaaaatgatgccatgaaaatttctatatgaccaccgttttcatggtaatggcttgttacggctgcctgtaattccacataggggataggccgtaattcacttaaccatcccctatcattgaccggctgggctttttctaatgtctttaagatcgttatacaggaaacctactccatatctggggttacgtcctcagggagcagcccagcaaaggctggtgaacagatttcacacctttggttcatcctgccaagctgctttcccgaaaagatgttccaatttcccctcccaccggcagtgcgtgggaatgcctgcccagccgccctcctctccctgagacggttcaggcccctggacagtcgcatcctctgctaggagggcaagagaaagcaggaaataatttggccagcaagtgaccccagacccagagccaggagtgatttttaacaagcctgattctcagaacagaacctgcagagaaaaagaaagcaagcaaggaaaaaaaaaaaaaaacccctctctactggaaaaaacatacacatacacagattaaaataatatttggcacttacgtcgcacttttaaaattcttcaaacgctttataaacactagctaattaattaagccgcctaaatctggctgcagtcggtggagagagctcgagaggagctaaaaaaaaaatgggggagccagcgctacacaactccagattttattgtcgcctgcctggggtgtgattacaggcctccggctgcaccacaagaatagccctgctccaacatgctgcacgcctgactccgcagcctctcctgcgcctcctgctccctcaccaactgctgactcacagccccttgtggtgttattgataaggataataataactgcaagccaggctgagtcccgggctccgggcctgcaccctcccctggatatgccagtatcaactccacctaacacatgaagagagaggagatttgcccagggtcatggagccaacgacatccttccttccttcattcattaccgcattcattctgcatatttttatcgatgacactgtgttttaggcaggaggttggaaacagtcccttgtggatcctacatcctactattgggaatgtgacaatccagagaaaatcaaatatgtgaataatacagctatgtgataataatgggaataagaattaaaacttacccagcacctatgcagcaggcataccaccgtgtcagggtcctcatgactgtgctggggtggatgccggaaccccacttcatggatgatggaatgggggtccagggaaggtgggtacagaggtggctaagaggggagccatgctgtcacccaggcctgctggccctagcaactgtgcttccccgaggcagcctttccagttggtccagtctcgaggctgaaatacagacctatccggaaagttcctagctcagtgctgctggtgctgcctctgatgtccccgcctggatgggcctcccgggcctcccacacatttggccaccagcctcacccctctcaggccgtctgatgctggctgggcctctgtccactgtgggttctgtctgtccactgtgggttctgtttttttctcctgtgccatgaagatcttgccatgttcaacttcaaatggaaatgaaatgagaagctggacttcctgataataaaagcagttgaggtcttaagtggttgatcaggaaaaggaagtcgaaatggtaatatttacacccaaagcaggtggagtggtcttaggcactctgagactccactcacctgccatgagaaccgggccccaagggtgatcccttgccagagtcaagactgggtgaggctgggaatgggagaaagaggcaggacaatgggcagatagccctgggcttcctgcagtgagggcagataggggtctgtgagcctctttccctggctgccctgcccctgccagtggggtggtgccaggccatgggttggtgggcaaattcacagggtctctctcctccccagccagagccagaggggcacagcagctctggacatctgccgcagccttgtctgatgtacaaggcaaaggtggcccaggtcagggcaggacaaggtcacatgaagggtcagtggagagcccaactggggccccaggtcacctgtcacctgcataccaggtagctgccactcctctgtctacctggttctctccttctcccctattctagctcgctctctcactctgcgtctgtctctcaggcatgtgtttctctgaggtctttatgatcatgatctttcttttttttgtttcttgtacctcaccttgttcagaatcgaggccctggctctgccttgctctgaactgttctcacttggtccctatccatcttcaacgcatctcatgacaagctcgtcctgccctcttcctgtctgggctccccccgtgcaccccaatctctccacccagggtccctgtcttgtgtgccccagtgtctctgattggggctcaggctcctgcagccaacctctacaattccttccagctgcccatttgggagcccttgaggcctggactgggtccagctccagtgtgtccccatcacagtgaggcctggatcacagggcatcagcaggtgttggtgagagtgaagtttgagccacagccacctccttgtttattcaatgtatagtaacaacaacttcctcagggcccatctcagggctaagtgacttctatgtgtgatctcgttttcttttcagaacaaagcagaggcctgggggctgttctacccatcctgtagataagaaaactgagactcaaaactgatggataaattaaggtcccacaagaacaaggggcgagccaggtttcaaaccaggtccgatgactctaaagaccagatgctgcatttggacgctgtccccagccttggcttattttatcctcccagagatccatcgaggtggggtcatagtaactattttacagatgaagaaaccaaggctgagagcagtaagggcaaactaagggcagctcttgcatttgtgtgacactttgctagccaggctcagtcctgggttccaggtggggactcaaacacactggcacgagtctacattggatattcttggttacctgagtggtggcccaaggacacagctataggccactgatccagaactcaaactacattctcctactgcccaaaccgctgagtacagcctcccttctcggggcctgcatcctgggccaggccagaaacagaatcttaacaccttgtacagccccagatatgccaggcccctacctctgagtctttgcccaggctgttccctctgtctggaataccaggctcccttctggctcattcagattagaattagcccagctcagatgtgactcttccagagagggtccaggcattcaaacccactctctgccatgtcatttagctttctgtgcctcagtgtccccacttagaatacaggctcatgttgcaggtttgttgtgagggtcaaatgagatgatacatgcactatactgatctcacagcctgcttctggtgtgcatccagtcaatgaacgtcattgataaacacttgaggaaacacagaggatcacgtaaggatgaaaaaatgactgctttgtgctcctttccaggagtggcgggtgaggaggagctgcaggtgattcagcctgacaagtccgtgttggttgcagctggagagacagccactctgcgctgcactgcgacctctctgatccctgtggggcccatccagtggttcagaggagctggaccaggccgggaattaatctacaatcaaaaagaaggccacttcccccgggtaacaactgtttcagacctcacaaagagaaacaacatggacttttccatccgcatcggtaacatcaccccagcagatgccggcacctactactgtgtgaagttccggaaagggagccccgatgacgtggagtttaagtctggagcaggcactgagctgtctgtgcgcggtgagtacagcgtgggcctcctttgcctctggtttgtgacagtaactcaataataacaccctccattctttgagcaatgatcaggtgtggtggtaggtgctcctttccatgaattgatgtctcccccttttacaaataagggaagttgaggcctgaagacgtcatgctatttgctgaaggctccacagctggtaaagggtgggaacatctgcatccttcatctgcctggctgtgtagccctggcctcttcaaagctgacccagccctttcattccacagatgaggaaactgacagatagtgtgacttgcccaggcacaggaccagacctcacctgctgcctccagagagcacttccctctcagggcagccgagtctcctctatgtgacaggcactcactgagaacctactgtgtgccaggctccgccaagcttgtgttctcatcccttccaataagagatccacccagggcagggagcagagagggtgtgtttcctttatttcatcaccaaacaccaactgagaagattcctaaaaggcacagatttactgtttaatctgatggccctggtgagaggagaagccagagggttgggcattttctgtgggtcttttagaaaaacacttgtgtgatttagggactgattcatgcgtcactaaaggctctgaacaaagctgggtcatcatagaatgtctctcaccccagggaggaggtctcccttctaggtgactttgggttcctccgttaaggcagcaaagatgctcattttgtatttactgccagagccccaggatccttgttctaactccgaatcctgggacattagtacaggaaggaccctcagaccatccagcccaacccctagttacaggtggaaacttgaagtcaggagatgacaggggccttgtccacagtcataggcccagttagtgacaggatctggaccagagcccacatctgattccagggaggctccttcattagccattgtttacatagaagagcctggtgcatcataggtgccgactgaaagctccttgaacagaactgctaagcaggaagccagcacttctcctttccatcagtttcctaaaggttcagaatattcacattcagaccgttaggcccactggtgattggaaaaccgctcccaaatgtaagccatatcatttgatactgagatttcatatcaggatagagacctgctccattgtgtaatagctacagaatactccagcttatggaaataccagatttattttaccatcttccattgatggatacgtaacttgtccccaaacttgaactattaaaacagtcctgcagtggatgaccttatacatgtgtgaccttactcaggtgggagacgcccactgcaagtgccattgctagatcagagggggtgtgtgttttaatgtgtgtggatatggcctaatttccctcctagacattataacaatcaagtctccccacaaccgctggacataggcagggagggtggctttatcctgattgtgcagatgttacaggaaaagacgttgaagttcccagatgatgcatctcgtgcctagacaatcacagcaaatacgtggctcaggtgtgacccagatctgctgactcctagcagagtgctcactcctctttgccatgctgtcagcctaaatgatgccctggatgagaaaggagggaggtgggagggggccagggagcagcagctggattggatcctcatcctggcactttctccttttataacaagtacttatgaaggaagagccatttcttgccccctttacagataaggactctgaggctcagagaggagacctgtgtggtgagccagtgggggagccaaggtttgatccccaccagcctgactcacagcccctgtctctgtaacactcagctatgcttgtcaaagtgtggagaaatgctccaccctactcattccaaactcttgcagttctatagcaataagcataggctgaggcaggagaatgcttgaacccaggagacggagattacagtgagccgagatcgcaccactgtactccagcctgggtgatagagcaagattctgtcttgaaagaaaaaacaaaacaagtcctatgggagtaggagggactggcccccatcagaaaggtcctgcagatgtctcatgatatgggaacttgttcctaaaggacaggtctcagcacatcactgagtagcatccatggagcagagttgggcctcctgcagcccagcagaccacgtgcccacctactcacggtgctgaggactaaggatgaggagatgaggcatttcctggtgggtgcttggggctcattggagcaagagtttatattatcccctcaggctgtcaggagcccactgacttcagtttatggctatagggtaaccagatctgggtaccctggagggaggcttctccctagaactgcatgaagtcagggatctcaaagggaaaaagggaaggtggtggtcagtgtcagggttcatgaagttcaggcacttgctcaattgattgacatgagagcttggggaacactggaaatgcccattgggtacatgagggatgaggagacagtgccttcgcttttctcagcctcagtttcctcatctgtagaatggtgataatcagggactcctttggcagagtggaaaggatttgagttcctgtgtataaaacacccaatgcagagtagacacccccaaatcaaggttttttgtttgtttgtttgttttttctttttttttgagatggagtttcactcttgttgcccaggctggagtgcaatggcaccatctcggctcactgcaacctccacctcctgggttcaagcgattctgcttcaacctcccaagtagctgggattacaggggcacccaccaccacaccagctttttttttttttttttttttttgtatttttagtagagacatggtttcatcatgttggcccggctggtcccaaactcctgacctcaggtgatccccccacctcggcctcccaaagtgctgggattacaggtgtgagccactgcgccctgccatcaaggtgttattttaagatgtgttaccttgggcaacccagttccccttgctgagcctcagtttccccatgcgtagaacgtcgataattgtaccaacctttccaggatgttatgaggatgcaatgagcctggggcgacgatagaccttagtaagcaatggggttttcccaaggtcatgtgatcttgggcaaatcctggcttcccttgagtcctcagcttccctgtctatgaaatgatgatgatgattgccaaccctcacaggttctgtgaggattggagaggatgtacagagcctcggaatggtggcggtgttcgggttatcactgagctcctgcagaagtgtggttaggagagtgtggccagagtccaactgcctgggccacatcccagctctgccacctcctggctctgtgacctgggacaaggcactccaccaccatgggcctcagtgtcctcacttgtcagtgataacaccaacctcacagaccaggagttgggaccgaatgagttaaatcctgtagcgtgcttagggcagcaggcgcctggcctgcagtcaatgttcaacagatgtgagctgtgtgatgctgaagccatgcaacctcagatgggttagtgctcctccaggcctcaaggataaatggtccttaggatgtactcaggtagttttcaatcttggctgctctttaggatcatctgggaaacattgaaataaatcccaggctccaccacagaaatgcctcttcaattggcctggcatgggcctaggcatctaaagtttttaattaatccagaagattctaatacagagtcaggactgaaaacccctgggatagacacccagaggtcacggaggacaagttggaaaagatggtcctcttggggtgccagatgggagaacagcttttcagggtgtggatgcttctgaacaacgtgcacccgggacagctctttggaggccccagtggcctggccagaccccctcttatgatacaggcctcgggggccaaggtaggggccccagacaaagccctgctcagatccagcctcagtgtggggaaaccttccatcctgaaaatgtttttgtctaaatgaccgccggaatcccagcaaatccttccaattcggccccagaaccctccctgcctcgacacaccaagatgtcacggaggagtctgttccctcctcctttaaaatgcttccagcttctgtaaatggctcttctggagggaggcgcctgtgatcttgtgttttgaaagccaattcgccaaacttgtttcctgaggggattgtttagaaaaggggagagaatcctcacttggtggtttctgctccttgtatcatttgggtttgtcatgagccacagggagcagggtttgagccttttcttggtgtttctgctctgctttgttctgctgcctgaaggataaatgtgtagattcggaagcagtaatgaccagacctcctgataacagtcacaggggtcatttattaagcacctgctgcataccaggctctgtgcttgcattcatcctccctcttcttaacagggtggggtttgtatccacttttggccctgggcctctctgagctttgtcctaaaaggggctcacacgaggatcccctcacagagatggagtgaggattaaagagctgacgggcatggagggagcagccagtgtccagctccagagaagccctggataaatgggaactgattgcagcccctcagccctgtggggacatccaggccgctggcctcaatgacttgacttcttcaagtgacaccctccttactgtgccctcaaaatgtttgatgggtgtgagggagaagttaatatttacaaatgcaagtatgtgtgatatgtgcttcctggtgactgcgataggaggtatggggtaatgattagcaatttggagacacgtttacgacccatctgcagggagaaacagcccgcgttctgattcagccatgtgtgtgctttcaggacccaggaagtgcttctgcctgcttgggcgccctgtgtctgtgtaattaattgataattaaccactttggctttctccacacttggtgatctttagtgtctatctaaaactgacaccaaagaagaccgcagattcagaaaagtatcccttcctttcaaatttagcacttggcacagattagaccctgctggaatatttgtggagaaaatgaaaaatatgaagtaaattcataaatacctgaagagagagctttggatatgaataaagtctgggttaaagttagatctgtttttgcttatttttgtgaagcatcttctgtgtttatccaaagcaaaactgcttctgttgcctcatttaatcctcgctgcatcccagaaaggagaaatgctgctgttccattttacagacaaggagctgggtgtgccaggccgcccctctcatgggctgagcggcctggttccagctctcatggtgatgccacgttgctgcttactccctgcactgacctctataaacgctctctctgaggttggcactgttgccaggggaggcagggtagaaacagttaataccaaggatgagatggatcgttaattttgatcctgtgcccaaattgctggaagtcaccctgtgtggagtggagaagtttgaactcaggcctggacttccctctgggccctgcccctacactgtctgacctcacatgggtcctcacctctcccaacctttgcatcctgctctgtaaaatgacaataaggacaccgccctcattaatccttccacattattggaaggataaaaaataatgtctcagaaggttcttaacgtgtcacacacttatcgttagtgattgtcatctgagtcatgtctcctgattatcgatggtccttttgtagccaaaccctctgcccccgtggtatcgggccctgcggcgagggccacacctcagcacacagtgagcttcacctgcgagtcccacggcttctcacccagagacatcaccctgaaatggttcaaaaatgggaatgagctctcagacttccagaccaacgtggaccccgtaggagagagcgtgtcctacagcatccacagcacagccaaggtggtgctgacccgcgaggacgttcactctcaagtcatctgcgaggtggcccacgtcaccttgcagggggaccctcttcgtgggactgccaacttgtctgagaccatccgaggtagaagaccctcacccagcccaagcccacacctgaccgccaagcccaccccccaccaccctccactcatccagctctactcttgctccagggcttgaaatgcctggaacctaaattcctaactgcccacctcccatgcccctagatgtgccagccacttactaacattttaatggcagtggctgggtgaccacaccacccaccaggtgccaaggactgtgctagccgtttcatttatttcactgatagcaaacacagttaatgagtacctactatgaactaagcctctatgtgcttggtgattttctttattttgctacagttacaacattccaactgcatgccaggggtggtgcttatagatttccctcattcttagcctagtaggagctaccagtccttgagcacctactgtgtgctgggcgttgtgcttagtaatttcattcatatgcaaagagcaccctcaatgtctgagcacctgatgcctgcctagctctgtcctggtgatgacctcaccgtggtgggggagctacgttatggagccctccctgtgatctgtctgtgccacaaggtcagagcttctgccctgtgctgtttcagttccacccaccttggaggttactcaacagcccgtgagggcagagaaccaggtgaatgtcacctgccaggtgaggaagttctacccccagagactacagctgacctggttggagaatggaaacgtgtcccggacagaaacggcctcaaccgttacagagaacaaggatggtacctacaactggatgagctggctcctggtgaatgtatctgcccacagggatgatgtgaagctcacctgccaggtggagcatgacgggcagccagcggtcagcaaaagccatgacctgaaggtctcagcccacccgaaggagcagggctcaaataccgccgctggtgaggcctctatttcagctgacccagcttttttaaacttttagttttgtgggttttttaaatgttaaaagtagtaattcatgcttattatagaacaatctagaagtctataaatataaagtagaattttaatgtcagctccatttccccaaatcccacactccaagagtcaccactggtaagagtttgatgcacatcttgatagatcttttgacatagatttatatcacaggaggaaagagggagagagggggcccatctgttcatggtgtcctgcctcttgccttcttcacctgacagttgtcatgctccccattcctcactggcccagcccctcttccctactctttctagcccctgcctcatctccctggctgccattgggagcctgccccactggaagccagggtggagtcattcagggtgtttgcagcttgtctcacatacagtcagtgcttcagtgaacatccttgtgcatgttccatcccacatgtgactatttctgtgtgattgcccaaggaacactttaggccaaaatgcatactcatgtaaggaggagataatgctgtcgctcccctgagagagtgtgagggtgtcaaggtatcattttctcagcccttgcaacgtggtgttggtgtacatctcttttgttttcaaatggtggcacctgattggcatttcagtgcagccatggaatatttcatcacctgttatcaatgtggctgatgccctgtacatagtagaacccttgaatggattagaatggaagccatttctgtccttcatgcacccttcagggaagctctcaaagacagccttggggctgtgtcaaagtggccctttggtttcaccaatgccaggttttcttaggatgtgtagggcatcggccaatgctgggttttcatagtacgtgtggagcattggccaatgccgggttttcctaggacgtgtagggcatcggccaatgccaggttttcatgggatgtgtagggcattgggcaatgctaggttttcatgggatgtgtagggcattgggcaatgccaggttttcatgggatgtgtagggcattgggagacaggatgtgtggctttccacgccagctatgttgcatacttggctgtgtgaccttggacaagtcagtgcctctctctgggcctccacttgcttctggctgtgttgaaggggatgagcttcatgacccctcagctctgagtctcagctggtaggggccatgattatcttgctcagcattgtagcttcagggcctgaccacagtaagcactcagtaaatgctttttgagtgaaagaggataaaagagtcagttggttggctggttggttggttggttggttggttggttggttggttggttggttacataatccttagttagccaatgaggtagagatgactgttggccccagtaacagaagaagcagccagggtttggagggaggcttaactgacttgtccagggtcacacagctacttagtagcatagatttgaaagcacttttctgtggcttagagccctgcttctgatgaaccactgtgttctagtctatgacccccttacctgtgctgtgggcagtcaagcctccattgtattttcaagagtcctggttcagagcccctatgctaactcctgagcccagtgtgcatggcccaggtgctgggcacagaccggtcgtcagcccctgagctgtgcagagcctgctggccgcactgcccttcttccagctgctgattcagtttccagtggatctggggtgccctcatgaccgctctgtggttcactccagatgagaaggaacgtttctgttcctcaggagtgagatttctgcctgtatcctgcagcaggggttcctccgtagctgtcagctacaaatatattcccccctggcacctcagcatggtttttgtgctgttcatggatgagtctcgtgggcaagtgtgtacagacccatgagtgtgcccatgtggctcgagacatctaagaaggtccagccagatgttctcagttaatgatgcctgcttagtggtgaaaagcagtggtgggtttggttttctgtttttaatctgcatacgtgaagcctctattccatgtggtccctagagaacactggatctaatgaacggaacatctatattgtggtgggtgtggtgtgcaccttgctggtggccctactgatggcggccctctacctcgtccgaatcagacagaagaaaggtgggtgcattcccctcttcctccctaagggtttgtccctggactgtcctcggagggagacgccattaggtgctttgggttaaggacatcagcttctgccagtagcaagaagtccagaggtagtggtgctagggctggggcagtggcctcaccatgttagagtctgggtgggtcactctgtggcttccccctcatggttacaagatgttcatcactgccccaggccccgtgtcctcaaggggccactactgagcaagggagctgccagcctgggaagagaggaggcagggactcttcttacctgtctcagggaggacatcgtctttcccaggagcctcccggcagacttctgctttcctggtacaagtctaggttacatgaccagtccctggacaggaggccagagggaatggagataatagcgccaccatttgattgggaggacttaacaagtgattgcatgggaaatgttagggaagtaacctggcacacaagtgctcaatgtatgtcagccctgattattacccgtattgtatgtgagcccagaaatatgagccacctccctagaaagccccctcacagggcaaggtgcatagcctttgactgcacagcaggagggcacagggtcaaacccaggacaccgcttccccttgtttgtgtgcacgtgttacgtgtgtgtctgtgtgtgtgtgctggttgttgggagggttggttgttgctgtggcagggcctctgactttgaagtcagacaaaccagggttccagaccctggttatatactgtaaacaatcaatttggcctctacaagcctcagtttccccatctgtaaaatgggtttagcaacgcctgtcttggagaagttacaagatccaaataagcccatgtgaaataacgggtctgacacattctaggatcgccataaatacatgttctctttcccactcttggagaagacaattttaagctggtatttctgcaacctttttttattacaagagatagaaatacatttcacatctcaacccaacacatacacacaccctttgtatataaaattaaaactgatattttcttttttgtcatattcttttttctgtttaaaatgctggttgtgacccaccgcctccaaagggacaagtgctgtcccgagctgcctttctgtggcctggcacagctgagcttggttgggcacattgtacactaatcacgcatcccttcagtagctccttcacctctgcctcccaagtttccctccctcctgggctggctctgagatactggccaagcctgatgcttctgtctgggagggttggagtcaggccctgcttctccagaatctgcaagacgtcccaccaagacgtctacccaatgggttccctaaagttcctggagagccccacacagggaggactcctccttggatggggaagcaggtcccttccccaccaagggtgacagcccatcccatgggatgaagcattcatagcagccgatagtgaaatcctggccatcctttctgagtctcaggcccaggcagcacgccagctcctggcacacgtgagctcattactgtgggcttaggtgttgcagaggaatggagtttgcagggctgcagctctggtaaaggccacccagcccgagtggcaggtctgtgtgcagagcctagctctcaaacacaggctccagtgacagggacggctagtatcccccagcagttccaatgtgccaggcactgctcactgtgctttccctgtagtaacagtcagtgctcaccacagacctcatgggtgacattactaaccccactttacagatgaggaaactgaggcatgggaaagttataaaacttgttcagggcctcacagccaggaggtggtggggccagaatttaaacccaaggaccatgtctaggaccaccttgcacactacctccctccgccataactagaccccccttctccctcattaggccctggaggggtctgcccagcctctcaatgctcacagtgaaatgtcctgatttcaactcaaccactacccagctgtgtgaccctgaggagtcacctagtctctctggtgtaaaagggggtgactggtgtcctatcactggattcccagagatgacttgtgtccagcactttgcaacctgtcagcctccactcagactttcggtgctgagcacagcttccaactggtacacctcatctaaagatccaggacctgcccaggcagcaagcgttaacccagcagcaagaattcttgcactgtggcagcctccagcctattaaagtgcggtgcagagtgcatttgggtgtgcatgttgctttttaattacaattttacagcaaaatgggagtcaaacggctgctgaaccctggaggcttctctgtgggttaccccatatcacaggtttaaaacctctgaaccagatggacactttctttccttccaagatcctttttttggaaagtggtggcatgtaaataaatggatgctcagcccaaccctgcaagttatagaagctgagagagaggaagtgacccacccggggtcacatggtgagtgagtgggtagcagacccggggttcacacatgatccccgatttgcagccctgctagaatctgttttcaagccacgaagggcactgattgggacctaggcttgttggagggtctccgctgaggtttgtggttgaatggaggtgagacccagacagaggtagggcggttgtcgcctcccaggctgaaggctgcttttggacccctggcaacttccagaagtggaaaagcaggaccatctagcttactccttcccaggcttccttggtggaagaggatgcccactgggtgggcatgggggtctcctgtggttccaaggatgtgattacagcatttcctctccatgtccctggaggcaaaccttttgccaaaaaatagttacataagaaaagtgtgcttctagttaaacaactggcttttgtttcttttgtctttcagcccagggctccacttcttctacaaggtaagtgcatcattggtccagaccctcttgcagttattatttggttatttgacagccccccagactacaaagcataatccatgtccactgacctcaccaatgtgttggtcaacatgtctctttctctcctttgtaacctcctcacactgggtcacgctgtttttaattattgtcccaaatgaggggtttttttggtgcacagaggtgctaatttcttgcctgctcttcccagacaacgagacccttgtctaatcccatgtggactggggcagagacctcccgggctttctgtcctcacagacatcctgcacacgccaccggatgcatcctcccagatccaagttgtatactttactctttcctttgtttagtaaatatttattgagtaccttggcgtgctgtgaccctggaatgccgggatgagtaggatagaatctgtgccctctgcaagctcacagcctggtcagaggctcagacggtgacattacatcactgatgtacgtcaccgatggcactttagtttgttgattcacatttttagtgacttgagtccctactatgtgccagccctgctcaggaccagctggtgatatagcagtaaacaagaatcagcccaggctttcatggggctcagacgccggtgagagaaacaggcataaacgcagaaataaagtgattcatggtgtcatatcaggtggtgacaactcctaccctgcaaggagatggaggtgaatggtggggggctgtcttaggcagaggaagggactgcctctgaaaaggggatgcaaacgggtgcctgaaactagtgagctatgttggacaggagcatgctgggccagagaggaggcctgtgtgctgggccagagggaaggagaggaagaagataaggtcaggaagacccaggtcctcggcatcccggtgtcctttgcagatgcccctgcagtcagaggtgttacgaactattctgtgaaaagcctttatcggctttttggaaggcctctgatcttcatccccagcagagcagaggcagcacaccatcatctgccatgtgaacccatctgcatagaaccatgtggacatccgtgctaagagtgataaataaaactataaatagcttcatgttggttcacaccaggttttgccagcaactgcatagtgccaatcttttgatggtttagagctttctgggtttcagaattacagaataggacatgatgatctggagtggggcctgtgggtgttagaaggactcgggattttatccgcagtgggatgaggaaccaaaagatggacacgatctgacttttgttttaaaagtgtcgcctggctacatgtggagcccagactacaggaggtgaggatgtgtaggtgaccatagcggtactggtccaagcagaaaaagatggtgacctggaccaaagtggtgggatgggctgagaagtgctcagattctggatatattttgaaggtagacacaagaggacttgctgatagattggctgtagggttaaggaccacctcaaggttgggggcagtggagtgctgtatcctgagttggggggtgcaggtgatgggtggagtgatggggcaaatatcaggcaaagcagttgcatatagcaggagcagctcttctgccagagaaggctctgggaagcatcaggtgccccgctcctgcccagcagtgtgagtccaaggtactcttgggataaagccttgcttcttgctctgatctccacagggggcctcctggtctgagccctgcccagcctcctggccttttcctcccctgaacaagcagagccgcctctccagcaaaactaggctcttcactgccttctgggcacatgtgttttccttttgtcatgcttgtgcctgtcacactcccacacctaggtcactcttccaagggcaagactcgtttatatcctttgccaaaaaaccttcagtggctctacctgtccctccagataaagtccagatgcccccctgaggctcctgggccccttgtggtccagttgccttgaacagtttcacttctagccaccccctgtcctcacatttcacggctcaaccacactgtgctccccccttccctcctcccacagtctgccctcctcccccttgcacactgccctcactgctggggtgtgctccctgcccctgctcatgcactacccagggtcccccagctccaggggtggcaggcacagtgggctctgtgaatggcaccccctggagttatgcaatgtggtagctagagtgggacccctcctgtcacctgctcacctcctgcttctcctgagatcagcaagggcacgacatcctccagggtcggagggcttcctgtgaaccctcctggtgccgcagcgtggacaccctggtgtgttcaaggtgtctctgcacctgtcccatttcataacccacccctcaaggccagggccaatgtccctgaggttcactgcaaatagctgctaaacttggcaccatgcctggaatgggataggtgcttagtaaaggtttactgactgaacaagtgaacaaacgaatgaatgaatggatcagtgcataccatcctaaaccactgtagcacgtcccactctgccttctctgaatccctaaaatgctgcttcccagtggctacacagccccatctaggaggatctctcttttttgttttttttgttgttatttttttattttttatttttgagacggagttttgctcttgttgcccatgctggagtgcagtggtgcgatcttggctcaccacaacctccgcttcctaggttcagatgattctcctgcctcagcctcctgagtagctgggattacaggcatgcgccaccacccccggctaattttgtatttttagtagagatggggtttctccttgttggtcaggctggtcttgaactcccgacctcaggtaatccacctgcctcggcctcccaaagtgctggaattacaggcgtaagccactgcgcccggccctgttgtcattattttttacttgtcttacctccccgattagacaatgagtttctggaagaataggacattgtcgataatagtaacagcaatagcagctaccatttattgagcacttactgtgctcctggcactatctatgcctttatgtgtattaacccacttgtgattttaattcttgcaggaaccctatgatttatcactgtcccaagttcatagaacagtgtttttcaaacttgagtgtgctacagaatccccaaaggacttgttaaaacacagattactgggccccacccccaaagtccctgattgagaatctctatttccacaagttctcaggtggtgctgatgctgttgttccccagccacactttgggaacccctgttctagaaggttcttattccctatcctatggttgaggaaattgaggctcagagaagtcgtgacattcccgaggtcctgcggctaggaagcaccggaatgatgacttcagcctcgacatctcttgtactaaagctagtgccttcatcactgttcccatgcttcttgctgtctatttcttcttccccagagaaaccaaccgttttctgcctgttttttatttttccagcgtgagcctaccaagggagccatgagatcacttgctccctttcatctctctaaaccaaagcaatagctagtgagtgctaatggtggtttcccatgtagcagccagcttcggctttggcttgctgggatcagacattttccagaggacgttggtgtgagtaacagctgagcacctcagggaggctgcaagcggggaggctgccactttgagctcaaggggttcttcaggttgcagggctggtggagggattggctctctctaactccctgggttaggaatgtacagacagaatattgtctgtaatcttccccagctcagatgagagaaaaatgtgtctctgctcccttaatggggcactgatcattcgatcagccatttattcacttgtcagacattcactgcatttattcttggaatatttagggcttccctgagtctttcatttattcgtcgggactgagcctaactcagtgccaagccttgagcagagggttgcaaaggggagcagaaaaggcccacccctggtctcatggcacttaagagccagtgagaaagattcattcattcattcattcattcattcattcagcaaatacatatggactgctgacgatgtgccagcccagttcttggtgctggggcttcagcagtgaatgagactggcccagttcctccctgtgtgaagctcagtgtccgctgaggagacaggttaccagacaagctggaaagttaataagggatgtggtgcagctgctgactagataaaatgaagccaggtatgggatagagcagatcaaggaggtggggtctggggcgagcagggagggcttgtctgcaaggtgacatttagaagatcactgaaggatgaggaggttccagccaagggaatatctgggacaagactgcaccaatcaaagggaacagccagtgccaagaccctgagacgggagcagtcagatgcatgcacagaacgcagaggaggccagaggagctggagcagagcagaggcaggagagggatggagcctagagcagttggccgagctgagccttggagctggtgtcacttgaccaccttggagtggttatagaggggttgagcattctgagcagaaaagtaacatgacatcacttatgcatttcagatagggagaatggagggcagggaagcaggaatagaggtggggagatcaaggaggaggttcttcaggaatcaggggagttcggatggtggagaggatggggtggctggctttgatggatattttggaggtggagccgacgagccctaggttggattagatgagagctgtaaaggaagagagagaagaatcaggactgactcccacttctccagcctgagcacaggatgaccgatggtagagctattcactgaaataggaaaatccaggggagacacagatatggggaaaatgataattggttattgtctgaaattgctttgaaagagaagaacccaatgttttgagaatggagtttgggggttcagtgaatatttccccaagaaaaggctgtttaaaaatagcatctgaaggaagaaaaggattaaagcagattaagaggcagcagcatggagcatgcaaaggccctggggcagcctgactggcattcattccaagtcactgtttttgagcacatgtggtgaggaagcatggcaggcaggcaggcagacagcaatagaaaccagatatgcagatagacaggagatctgagattgtcatggaggggcagcccagccagcgcagcactgtcagcagagccatcacaaggtgacaccatagttgagtcttgaaggaaacaggaaagttagccaagaggaaaaatgatcaaaggggtccttcgaggctgctattgaagcatgaagtacataacatcaaatgccaccccccccccgaaatatctggtgggcagatgagtgggtacatgagggcagggcagtgaattagcctggaggcagcacgtcagaccacgtgggactctgagcagggcgatgagttggacttgaaccagccagccagtgggaagctccaggagggctggaggccagtagtgtggggacagatctgcgtgatcttccccagcagacgtgcccctgctcctggagggttctttctgtggccacgtggggcttgtcatgtctcagaactgctttcagagccaagcactcatgccaaatccattaataaccctgctgccaagccccactgctcatttctgacattatccatgctaacatccccggggttgccggcttgagaatttacacaacttctgccaagccagtggctctggtttgctcatcaccttgaccgtgaccctccagtgagtcaagtcatgacctccaattacagaagcaagtgcacgaacaacttctttgattaacttggacatcttggtctttttcttttctttctttaatgatgatacatagatgtttataatacagaacatttggagaatatgggaaactaaaaaggagaaaaaaaataccatgcaaagaccactgcagtttgcattttgctatgtttccttccagtgttatccacacatttttcataattgagataatcctacagagaattttcctttttcacttatcattttaatgtaagcaattttaacttaaaaaaaaaacctcctcataaaccttttaaatctttatctgtggatttatcctaatttccctaaccagtcccaattggcagagccctaagacataaacctcctcccccatccagcccttgacaaatgcctttgtgttgaaagctttttctatattttgaattcccccaaaaaaaagtgcaattatgagtcaaaggatgaggacatcttccaagctcttgattttgccagctgcttcccaaaaggattgtactggtttgcctctcccaccagtgacgtatgaaagctccagttcatttcaccatagcttccccagcaccaagtattataatttttaaagatccttgccaatagagtaggttaaaaaaatgatagtgcattgcttagaattcctttttagtgagattgacccctttgtccaaacatttgatatgcagttgtatttctgttatgagtccttcgttcatgtcctcaacccatatagaaaatggagcctaaatgttattcttatcagtttgcatgagcacttgagatagtgagggtatttttatctgtgtgtctctttcctttttaggttgcatgagcccgagaagaatgccagagaaataacacaggtacagtccttggtgagatgcccttcctgggaaactccgtggcgtggttgcttcacatcaaccggaattgcagatctggttctaaattaagactccttgtggggtggagggtggaggatcttacactcctagctttccccatgtcctgtgcatattccttctctctactgcagccaagagtggctgttgcagcctcatgactcagtgcgacccattgcacaactccccaggggcaccattcacaatccgtcctatgaaaatggtgccctggagtcaggctgcagctcccttagtgtggatcgtgccttcccatctctctacatttgcccaggcccatccctctaccaggagcgccactcccagctcactgcccgctcctcacagccaggcttttctatgctggaactgcaaagcccagcctgccagggcctctcccacctttgctgatggaaagaccccatgtcattaattacctcacacaagggcacactcactcaagctggaggtttctggtcagcattgctgagatgattttgcagcaacacggtttctgagaaacctagccctgcttatcaccggctgatgctgtcagaccttgaaggcagagggctgctcagcatcttgtaacaagacaggccctgctctgaacccggaacgagagcgcgccagctgtccttgacatttccaaggcagttgtcatctttttagatgtaatctgttgaaggagtcgggctggtgaaaggcgcagcatttgtagaccaaaatgccttggccctgcccttgtgacccatggggtccccccgcagccccggacatgagctcgagttgtaattaagaaaaaacaatttccagtcatgagcgagggagatcttctcccccatcattttacttctggacttcctcctggaatcttctgggggaaaaaaatgatggtgagaagaatgggtcatggaaacctctacgaaattcacagcagagacttactgggcacccactgtgtgccacgcactggacagtgagccagacagtcacagcccagctggcagagtgcctgcgattccagtgccaggtgccagccctggccagggagggagttgcacgctgtcaacacggatttcccagacagaagcaaatgagagcacgcagggctcaggacagaggagctgtgtgctaagagcacagtcgtagagtccaacacactttggttctttgccagccggacaactttgtccactttattgaacctcccttggtctcagtgtcttcagccgtaaagtggaatagataatccttcccaagcagggttgtggtaagagtggatggggtgatctatgtgattgtgtgctgcttgtaagccctgagaactgaaatcagccattaccgtgcaccaactaggaggtgtgccggttggtggtagctttattctgttctatcacgcaggggccagtcacagagggagcaaagtttatcattcatgatgggcgcttttgaggcggcagtggcaggttgataggattagcacatgggaggtatccaagtttgctaagtggttaatgattgcgaacatttattgaagacagatgctcaataggtaccaggctctgttctaaacgctttacctggataatctcattccatcctcacagcaaccctggcagtagacactattatcatcccctctttacagatggagaaactgaggcccagagaggttaagtgaattgctcaaaatccctgagctagaaccaggattcaaacccaggctttctgactccagaacgtttcccgcttcactaactggcgatctcgttcttatactgcccctgttctctgtctccctgtccccagctttgccctgagtgaaggtgaaattattgccatccactcatatattcattcaatatggatcagacttcttatgtgccagccttggtttctgaatcataacaaatgcccagtgaatatttgtggaataaacgcatacattaatgaatgtccccacacgtaccaccatcagcagcacctcctcaggcccccaaacagacatggtcctgggtagcgggccctgtgatggaaaacaaacatgggctgaggaagcacaaagaaggaacatggaccctgccaggagaggggagagccagggagggtcttagtatgagccatgcttcatctgaaatttacatggtggattgggatttgttacaaggagaagcaggacagacaccctcgagggatgaacatgagaaatgggtgaagactgcaggtggttcaggctaggaggaggcaggaacgggaggaggtgacactgaggcggggctgtgaggagactgcactgtgcgggtcagaaagacccttcaggcagggtgaggaggagggcagatgggaaggggcaaggctggaggcaagtaacgttggcaagagatgaggggaacatgacttatggctgagccagtgtgggccgagaggacacagaagcatccagacttggtattcagtttgagtgagtgggccaggggctatagaatgaccttctcatgactttctctttgggtatcttaaatccaggacacaaatgatatcacatatgcagacctgaacctgcccaaggggaagaagcctgctccccaggctgcggagcccaacaaccacacggagtatgccagcattcagaccagcccgcagcccgcgtcggaggacaccctcacctatgctgacctggacatggtccacctcaaccggacccccaagcagccggcccccaagcctgagccgtccttctcagagtacgccagcgtccaggtcccgaggaagtgaatgggaccgtggtttgctctagcacccatctctacgcgctttcttgtcccacagggagccgccgtgatgagcacagccaacccagttcccggagggctggggcggtgcaggctctgggacccaggggccagggtggctcttctctccccacccctccttggctctccagcacttcctgggcagccacggccccctccccccacattgccacatacctggaggctgacgttgccaaaccagccagggaaccaacctgggaagtggccagaactgcctggggtccaagaactcttgtgcctccgtccatcaccatgtgggttttgaagaccctcgactgcctccccgatgctccgaagcctgatcttccagggtggggaggagaaaatcccacctcccctgacctccaccacctccaccaccaccaccaccaccaccaccaccactaccaccaccacccaactggggctagagtggggaagatttcccctttagatcaaactgccccttccatggaaaagctggaaaaaaactctggaacccatatccaggcttggtgaggttgctgccaacagtcctggcctcccccatccctaggctaaagagccatgagtcctggaggaggagaggacccctcccaaaggactggagacaaaaccctctgcttccttgggtccctccaagactccctggggcccaactgtgttgctccacccggacccatctctcccttctagacctgagcttgcccctccagctagcactaagcaacatctcgctgtggacgcctgtaaattactgagaaatgtgaaacgtgcaatcttgaaactgaggtgttagaaaacttgatctgtggtgttttgttttgttttttttcttaaaacaacagcaacgtgatcttggctgtctgtcatgtgttgaagtccatggttgggtcttgtgaagtctgaggtttaacagtttgttgtcctggagggattttcttacagcgaagacttgagttcctccaagtcccagaaccccaagaatgggcaagaaggatcaggtcagccactccctggagacacagccttctggctgggactgacttggccatgttctcagctgagccacgcggctggtagtgcagccttctgtgaccccgctgtggtaagtccagcctgcccagggctgctgagggctgcctcttgacagtgcagtcttatcgagacccaatgcctcagtctgctcatccgtaaagtggggatagtgaagatgacacccctccccaccacctctcataagcactttaggaacacacagagggtagggatagtggccctggccgtctatcctacccctttagtgaccgcccccatcccggctttctgagctgatccttgaagaagaaatcttccatttctgctctcaaaccctactgggatcaaactggaataaattgaagacagccagggggatggtgcagctgtgaagctcgggctgattccccctctgtcccagaaggttggccagagggtgtgacccagttaccctttaacccccacccttccagtcgggtgtgagggcctgaccgggcccagggcaagcagatgtcgcaagccctatttattcagtcttcactataactcttagagttgagacgctaatgttcatgactcctggccttgggatgcccaagggatttctggctcaggctgtaaaagtagctgagccatcctgcccattcctggaggtcctacaggtgaaactgcaggagctcagcatagacccagctctctgggggatggtcacctggtgatttcaatgatggcatccaggaattagctgagccaacagaccatgtggacagctttggccagagctcccgtgtggcatctgggagccacagtgacccagccacctggctcaggctagttccaaattccaaaagattggcttgtaaaccttcgtctccctctcttttacccagagacagcacatacgtgtgcacacgcatgcacacacacattcagtattttaaaagaatgttttcttggtgccattttcattttattttattttttaattcttggagggggaaataagggaataaggccaaggaagatgtatagctttagctttagcctggcaacctggagaatccacataccttgtgtattgaaccccaggaaaaggaagaggtcgaaccaaccctgcggaaggagcatggtttcaggagtttattttaagactgctgggaaggaaacaggccccattttgtatatagttgcaacttaaactttttggcttgcaaaatatttttgtaataaagatttctgggtaataatgag

SEQ ID NO: 31 - DNA, 43093 bp, Homo sapiens
agaattctttggcaggggcgaccttagaatcctggggaggagcgagaatggaatcccggggaggaacaggggtggaatccggggggcggggtcagaacgccaggagggggcggggccggagccagggtcggcttgactcgggggagcagcgggtggatcctgtgacgtcagcgggttcgaaccgccggagctgagcgagaggccgggggtgccgagccgggcggggagagctgggccgggagagcagaacagggaggctagagcgcagcgggaaccggcccggagccggagccggagccccacaggcacctactaaaccgcccagccgatcggcccccacagagtggcccgcgggcctccggccgggcccagtcccctcccgggccctccatggcccgggccgctgccctcctgccgtcgagatcgccgccgacgccgctgctgtggccgctgctgctgctgctgctcctggaaaccggtgagacgagcggacggccccctgccctcgcgcggaccccctccaaccttaccttccgagctggggaagccgagcaccttccccgcccacccccggctccccgagccccctctcgcgtgcccccttcctggctggccccacagactccgaccccctacacgtccgattctctcgaggagactctgacccctcctttctgcatctctctcaccaccacccccatccttcttaatccaattgcccatcctacgcctgcttgtctgtccccctccccatttctcggattcccgcgccgaaagggttaaatcccaggaaggcctggtgccccctccccaccccgcgccgagtagttcacccggatctgggtctctgtctcctctacccctctcaggaatgtggggaatgttccccccacctaccgcagtaaggtctcgaggaagaggcgagaccacctccctcccctatttttccttcttcccggcttgggcgtctgaggcccggagagaactgaggacaagcggacctgattcgggtcccttggagggctaaggataagagttctggcgacttagggggaagggcctgagctcggagctccaaccccgaacctcagggagttgggggttctgactccgtggactccagaaaaattaggggccgggggctccgtcttcagggtccctggtagaatggaggctaggcgctaagtctaactgggatctaggtaaaactgggggcgagagaggatcaaacttgtagcttctggatttaattgtgggcagggggcttcgttttcagggttcccggcagaaccgggggacaggagactcgatctcgtgggcttcagacttaattgtaggcagaggaacgtcttctgagatccaaacagaagtgcgagcagcgggccccgtctcttgggctccagatatgatcaagggtcgaaggctctgtcttgaggctggagtctcagtcgcctgagtcccagatagaacgggaggccccgagtcccagaggctgggagactcctccctttccctatgaatggtcgggggcgacggagacgtcgccggggaagttttcctggtttcactctcgccgagccagggaggggcggggcgggcgctcctggctccgggttccggactccccggtttcgggaccttatctatcctctggtagcgcctttgtcctcagagccatagcaggaggtggacgagtggagccgccgcccttatcccccgtccctcccattgctatgccttggaccccctggcgtccttccatccaccccactaggggaggagagcggcccccctggggagggaggggctgggagggaacccttgaaagaggcgctggccccgccccttgcaggtgacccggttgtgtattcccagcgacaaactctgggatgctagagtttcccgagggtttgcgcagaagagagctcagggggatcttgggggaaccccggccacctctctggcctcatttcccccaggatggctctcactggcctcccagctttgacccagagctgggaactccgcttccatcccctgcctctcccttcaggcagaaataggcagatgagatcagaactggcacctctgggtgaattctccgaacccaccagaccctgagcctactgttagcttggtgcatgatctcaccgaaggctccagcttgccctgggaaacaggtcctgtttctgtttccatcttagagatgaggaaacaggctcagcaaaggcaagcagccttctcaaggtctcacagcaggtcccggggaagccgggctccggttcttcagagccccgcaccgggtgggctccaggaagtgcctctgagtttccatttcctccctcgtaaaaaaactgagataacaatcctttccctgcggaccatccggaaggctcccaggccccactgattccctgtgaaacctcttagcccctggagaaggagctgtcggcccctttcttgaccacccccaccccaatccttcgcctctgctgtccactggctggccggctggcatgtgctcgctctccctctctctctctctcccctccccctccctgttttcctccttccctcactttctttccccctcttcatctctcttcgtttctcaccctttctctctccatccctctccaagctctttctctcttctcctctccccatctctctctctcctctccgtctttctctgtatacctgtctagctccactgcctcccccgcttggcctcctcggggaatgcgggtgcaccacctgggcccccagctgggccggctcccctcccccagctttcttccctgcccatccgtgtgtccatgtccgccaggcagccccacgtagtggagggggaggggagcagagggacggcagcctggctgtctcctctcattagggaagggggactgggcagaggagaagttggggggtgggtatatagagaggctggagctacaaggatgggtacagaggccaatagagggaagcggtcagacacagatttaggaatggggtcagagacacgtgtaggaatggaatcagaggatagaaggggagtgaaatgccggcacagggtcgggggagtgaaataccgacacagggatgaggctgaaagacactggaatgggacggaggagggtgggggaagggagctagacatagataccagatgaaggcagggacaggaaaaggaaaggggtttggtgacaggcagggagccccaaagactccagctgtgggacagcagaggtgccgtgacccacggaggtcagggtacagggggcctcaaggccagcgacatgtgggggccacagggagtgatgaacacagaagggacagggagctgggcacatgggccagctcccccgcccctgcctgggacgctgttacatttttaatgtcccagcagtgctgacaaatggagcaggaaggggaggagaagaggggacccagcaagatgggccaggctgtgagaaggtgtgtcagaaatatggggagacagggcactggagacccaggaggcagggagactccacagtcagagacagaaacagagacgtagaccagaaggcttgtgagaagagaaccccaggaatcaaggcagagagccaggttccagacacagggagacccagacggagaaagagaccggagatgtcagacatacagaggaaagaggaagagagtgactaacggggacagggtatcttctcaggctaatgaaaatgttctataattgctcgggtgatggatggctaactctgaatatacaaaagccactgaactgtacactttaaatgggtagattgtatggtatgggaataatgtctcaataaagctgttacaaagagacagagaatataagaggcacagagcagagaccagagactctgggggacacagataagagtgacagaggccaggcacattggctcataccagtaattccagcactttgggaggctgacgcaggagaatcgtttgaaccgagttcaaggctgcagtgagccctgattgcactactgcactccagcctgggccacagagcaagaccctgtctcaaaagagaaaagagtaacagagaccccaagagagaccctgggaattggagacacagagggacagggaccctaagaactagacacagagagagatagaagaggccccggaagacacagataagagacgctaagagacagcagggataccattaaaagactttcaagaagccaggcatggtgactcatgcctataatcctagcattctgggaggtccaggcaggtgtatcacttgagctcaggagttcgagaccagcctgggcaacacggcgaaaccctgtctctgcaaaaaatttaaaaattagccaaaggtggtggtgtgtgcctatagtcccagctacttggaaggctgaagtgggaggatcacatgagccaggaaggttgaggctgcagtgagctgagatcacaccacagtactccaccctgggcaacaaagcaagatcctatctcaaaaaaacaaaacaaaacacacggattagaggaggccagggggcaggtgcagaaatccaggcacagacagacagccctacatcctggctgctgcagccgctgctcactccctgaaccagctcctggatttccgctgtgggggttgggcactgtgattaatacaattaattaactgacaaggtgactgaggcagcagctgaggccagtactcaaagcctctggccttcaagggccttctctagtcccgacgtgccttgccatgggaggctgggtcgctgtgctttatagatctgcgggggaagccaggccctggggagccagccaggcaggagtccaggagcccagctcctcctcccctagacccaggtgtccagcttcaggccccgcctccctcagacccagaagcccaggccccagcctctcctccctcagacccaggagtccaggccccagccctcttccctcagacccaggagtccaggcccccatccctaatccctcagacctgggagttcaggcccccatccctgctctctcagacccaggagtccaggccaccagtgcttcctccctcagacccaggagtccaggcccccatccttcccctctcagacccaggagtccaggcccttagtccctcctccctcagacccaggggtccagcctcagtcccctgctccctcagacccaggagcccaggccccctgctcttcctccctcaaacctgggagtctaggcctccagctcctcctccctcagacccaggaatccaggcccccagccccctcctttctcagacccaggagtccaagcccccaacctctcctccagggttccataggtcactctgcaccctcctcgctgccttggtctacccatccctggatctcggggtctcaagctgtgtctgtccccattgttctcccatgggctcacactacaccctgggcagcctccactctgccaccacaggaagcctgcaggtgcagtccacagggagaggaagtgtgtctggggacccagctcacacttcatgaagctgtcaccagtctggcttgcccagtgacactgagggaggctggtgttcccatggccacagtcccctggctatggtgctggccatgtcctggccaagttcatggcacagcccctgcctagcagtgtgctggatgatgggggctcactccaggctgaccaacctcctggctgtatctcccttgcctccacctgacatgcagagcgtctgggcagcggccctcacccctgtcccctttacctccgcagccctgtcagcctccaagtcccaaccctcccagcttctccctgtcacccccaccgctggtcctgctttcccattccaagttctgagtgtgtttccaatctcgccatcctccgtccccacagccccgaccctgatcccggcgcctccccccgagacccctgccccactgagggctctttcttttttcttttttttctttttttgagacaagagtctcactctgttgcccaagctggcaatagtgtctcactctctcactctgtcttccaagctggtacagtggtgtgatcttggctcactgcaacctccgcctcccaggttcaagcaattcttgtgcctcagcctcccaagtagtggggattacaggcaggtgccaccatgcccagctaatttttgtatttttagtagagacgggctctcaccgtgttgcccaggctggtctcctgagctcaggtgagccactgcacccagcctgtgagggttttttctttctctttttgttttttttgttttttttttgagacatggtagccaccacctgtaatcccagctactcaggaggctgaggcaggagcccgagacagagcaagactccgtctcaaaaaaaaaaaaaaacagaaaagacttgggcttgtttcctgagggctctgtgcagaggagggcgtgttctgcactttctagcaggatccttctagctgtgcataggaacaaaccacaaggacaactgcagtcctccaggtgggaagtggcagtggattagaccagggcagggactggggaggcgtcagaggtggtctaactagataaatgtcaaagaaggaggtgacagggtttcctgatagattgcttatgaggtgagagagaaagaggtgaaaatgccttaaaaatggactgtaggcaggacgcggtggctcacgcctgtaatccaagcactttgggaggccaaggcaagaggatcgctttagttcaggagtttgagaacagcctaggcaacaaacagtgagaccccttctctacaaaaaaaaattttttttaattagtcaagtatggtggtgcccgcctgtagtcccaactactgagaaggctgaggtggtaggattgcttgaacccaagaggttgaggctgcggcaagctgggatcctgcactccaccctgagcaacggagtgagatcctatcccagaaaaaaaaaaaaggaatgttaaccccacagggcctgaactatcctattcattcatttggaattagaaattcagaatggggaacttacagcaatgggattttttttttcagacggagtctccctctgtccccccagctggagtgcagtggcgcgatctcagctcactgcaagctctgcctcccagattcacgccattctcctgcctcagcctcccgagtagctgggactacaggggcctgccaccacgcccagctaatttttatatttttaatagagacgtggtttcaccgtgttagccaggatggtctcaatctcctgacctcgtgatctgcctgccttggcctcccaaagtgctgggtttacaggcgtgagccaccacagctggccctttttttttttgagatggagtctcactctgtcccccaggctggagtgcagtgctgcaatctcagctcactacaacctccgcctgctaggttcaagtgattctcctgcctcagcctcctgaatagctgggattacgggggcccgccaccacgcccggctaatttttgtatttttagtagagacggggtttcaccatgttggccaggctggtctcaaactcctgacctcgtgatccgccctcctcggcctcccaaagtgttggaattacaggcgtgagccattgcgcccagggattttagaacctcattcattcgttattcagcaagtactgagcatctactaggtaccaatctctcttgcagatactgagggtacaggttgtgagcaaaacagacagaagatccctgccctcgtggcgctggcagtcagtttccaggaggatgtgatatatctagtgtgtgagatggtgagaagcactatgcagacagagaacgtaacagggcaaaagggcggaagagcagtcaaccagggaggggagaggaggtggcagctgaggtggagtatctcggggtaaaagaaccccccgaggagtgtgccccacaagaagctaaaagtggtgggtttgtttgagaccgagtcctcactctgtcacccaggctggagtgcagtggcgcaatctcagctcactgcaacctccacctcctgagttcaagcgactctccctaaagtagctggaattacaggcatgcagctaatttttgtatatttagtagagacagggtttcactgtgtcggccaggctggtctcgaactcctggcctcaagtgatccatccaccttggtctcccaaagttctgggattacaggcttgagccaccgccccatcctaaagtcggtttttttgttttaatcctccaaatccagtagtgctcagatgccatcctaaatggaggattggaggggagcctcccttagaaggaagatctgggcccctggaagccacaggactgctccttaagtcaagaactctgaatctggccaggtgcagtggcttatgcctataatcccaacactttgggaggccgaggcgggtggatcacttgaggtcaggagtccgagactagcctggctgacatggcgaaaccccatctctactaaaattacaaaaattagctgggtatggtggtacatgcctgtaatcccagctacttgggaggctgagacaggagaatcacttgagctggggaggcggaggctgtagtgagcccagattgcgccactgcactccagcccgggcaacagagtgagactccacctcaaaaaaaatttttttaaaaagaactctgagttgccgggcgcggtggctcacgcctgtaatcccagcactttgggagtcccaggcgggcggatcacgaggtcaggagatcgagaccatcctggttaacatggtgaaaccccatctctactaaaaaaattagccgggcgtcgtggcgggcacctgtagtcccagctactcgggaggctgaggcaggagaatggggtgaacccgggaggcggaggttgcagtgagccgagatcgcgctgctgcactccagcctgggtgacagagcaagactccgtctcaaaaaaaaaaaaaagaactctgagtcagcctggcgcagtggctcacacctgtaatctcagcactttgggaggccgaggcgggcagatcacgaggtcaggagatcgagaccatcctggctaacacggtgaaaccccgtctctactaaaaatacaaaaaattagcagagcgtggtggcgggcgcctgtagtcccagctactcgggaggctgaggcaggagaatggcatgaacctgggaggcggaggttgcagtgagccgagatagtggcactgcactccagcctgggcgaaagagtgagaatctgtctcaaaaaaaaaagaaaaaaactctgaatcccagagacccagggacttggaggaggtgaagggtgtggggctccagggacctggggctcagcttttcaggtctcctcctccaggaagctcttctttcgttcatcgtccctccctccttcagacaggtcaagcctcttcaggttcctcccataccacccctactccgtcttccaggcattcttggtgataattatttgtgcaatatttgtaccccctgcaatctggatgtcaaccctggaaaacaagcacctgatttgtcctgttacttctgcagcatccacacttagcaacattcattcacttggcagtgtttactgagcacctactacatgctaggccctgttgtaggtgctggggatacagtaggggaaaaacacagacaaacctcagggctggagagggcagaccctctagcacccaggacctgtttgttgagtaactatttgttttttggatttgacctataagatgtgaaagaacagccagattcttccaggttctgccttttcctgatccctccctctctccctactaccaaatcccttccattttaaaattttaaatcctggtggggcacagtggctcacgcctataatcccagcagtttgggaggctaaggtaggcagatcacctgaggtcgggagttcgaggccagcctggccaagatggtgaaaccctgtctctactcaaaatacaaaaattagctgagtgtggtgacatatgcctgtaatcccagctactcgggaggttgaggcagaattgcttgaacccagaggcagaggttgcagggagccaagatggcgccactacactctggcctgggtgatacagcgagaatgtgtttcaaaaaaataaaatcctaagacctattagcctcctccccaacactcagtctcagtcttaacctcttgttcttttcattgccaactttttgtgtcattttgctgtctggtcatctatctctgctcagcccaccaccttcccctcaggcctccttggatgaagttaagtcattctctatttgaagaacccgcaacggctcccacttgccacaaagaggaaactaacttcctcggccccagcctactttgctgtctctgcagttcacacaggcccaaatggctttccttgaccctcattgagtggccttccccccttgcctagctaggaaggggccagagcgcttaaccaccctgatcccaaccttagtgcctttgggggccaggcgggtgataagtcccagcacctggggaatctggaggagccggaagggagtgtgccttgtgggaggggggtgatgtccttcctcagccccacccagctgttgcccccaggagccacatatccggacttctgtctggagctttagacagcaatctccaggccttctgtgtgggctgctacttcccaactgaaataacactctgtgggccaaagcaaacatgcaccacagtcagatctggcctgcagcaggcggctgacccctgctgctctgctcacctgggccacgccccgtgaacatcccccatgagcaagtccttccctggaactggcacaagggaccctggagggtggctgaaacatccccattttacagatggaggaagttgggcttggagacaaggctgccagctggaaagggtgtcagcgttaaataacaagattcagaaaataggattaagtatagagtttattcaagcctaaagcttgaggatggccaccccggagtgtggattcaagttgccccaaataaaccctttgactagctgtgattacaagtggactttttttttttttttttgagacagggtctcaccctgtcactcagtctggagtgcagtgtgtgatcatggctcactgcagcgtcagtttctcgggctcctggccttgagtgattctcctgccacagcctccctagtagctgggactacaggccctagccatcttgcccagctattttttttttttgagacggagtcttgctctattgcccaggctggagtgtagtggcacaatctctgctcactgcaacctccacctcccgggttcaagcaatcctcctgcctcagcccccctagcagctaggattacaggcacctgccaccatgcccgggtaatgtttatttttttagtagagatgggatttcgccatgctggccaggctggtctcgaactcctgacctcaggtgatccacctgctttggcctcccaaagtgctgggattacaggcgtgagccatcgtgccgggtttttgtttttgtttttttttttttaagagatgaagtctcactatattgtccaggctggtctcaaactcctggcctcaagtgatcctccacccacttcggcctcccatagtgctgggattacaggcatgagccaacgcacccagtctgcaagtggatttttaaggaacaaagaagagagagttcctaaattgttaccaagaatttacattgaaacagcataaggtatctgcaggtctggctcagaaaaaaagataacagaaggtattgattggctatgcactgtttattgtatcacaaattccaggaacaagaagctaatggggagggcagctgtgcaggaaccactgcctcgggcatgggtggaggaggcgtgtgaccgaagtcccctattcactgtacagtctccctgggcctgatacatttcgcatagctcagactgatctgagctatttttcttttctcaagttgggtgggggtggcccctctggactggaaaagcctcatttttcccccaagtgacacacctgagtttgtttgacttgtttcccccaagtgacacacctgagtttgtgggacttgtgtggagatgatgtatttatgtcacacttcagtcttcgctgatggcttttttttttatatttatttacattttttcttttaaggtaggcagggcctcattctatcgcccatgttggagtgcagtggcgaggtctctgggttcaagtgattccccttcctcagcctcccaagtagctgggaatacaggggcccgccaccacgcccagctaatttttgtatttttggtagagacggggtttcaccatattggccaggctggtctcgaactcctgacctcagggtgatccatccgcctcggcctcccaaagtgctgggattacaggcatgagccgcagcacccagccttttttctttctttcttttctttttgtttcccctcccgagaccgagtctctctctgtcacccaggctggagtgcagtggtatgatctcagcttactgcaacctccacctcccgggttcaagcaattctcccaccttagcctcctgagtagctgggattacaggtgcctgccaccacacccagataatttttctatttttagtagagatggggttttgccatgttggccagtctggtctcaaactcctggccccaagtgagcctcctgcctcggcctcccaaagtgctgggattacaggtgtgagccaccacacctggccttattttatttttaatttctgttcttgtattgctataatttactgatgatttcttacccaaagatcctcggcctgtccccacccaaggggactgccttccaccggggacccctcataagagttactcattaggatggtgttccctggggttcctgtgtgtatgacgccagggcctgtgcaccgcctccatggcccatctccatcagacagagctgggcagtggtgttggccctcgaaatgaggcttgtgccctggcctttcctggcctgggggctgagtgccaaggccacctgtaattaaactgagcttcctatgtttacttagcaagcactgacctctcatttcctggggccctatgctgagtgttccacagctattctttaatctttaaacagcccttgggacgcaggcactattattaacctcacatcacagctggggaaactgaggcacagagaggttaagtggcctgcacaaggtcgcagagccaggattcaaacccatgaactatgggccactcagtcgccatgctgtactgccgtgcacagcagaggaagatttgttcttgttcttgtttatattaaaagtgagaaaacatgggccacacgccgtggctcacgcctgtaatcccagcactttgggaggccaaggcgggtggatcacctgaggtcaggagtttgaaaccagcctgaccaacatggtgaactctggtctctactaaaaattcaaaaatcagccggaccgtagtggctcgcacctgtaatcccagctactcaggaggctgaggcaggagaatcgcttgaacccaggaggcagaggttgcagtgagttgagaccgtgccactgcactccaacctgggtgacagagcaagactccgtctccaaaaaaaaaaaaaaaaggtgagaaaccacttaggctggctgagaactgcaaacatgcgtccacataaaaacttgaacttgcatgatcccagcagctttatttatcagagccaaaaagttgaaacaacctcaatgcctatcagcggctgaatggataaacaaaatgtggtccgtccatgtagtggaatattattgagccttaaagaagagtgaagcgccgacacgtgttacagatggatgaacctggaaaacaagatgccaagtgaaagaagccagacacaaaggctacatagtctattacatgaaatgtccagaacaggcacatcaacagagacagaaagttgcatcgtggctgggggaatgggaagtgactgcttaatggataagggggttacttagggaattataaaaatgcccaggctgggcgcagtggctcatgcccgtaatccgaacactttgggaggccgaggcaggtggatcgcttgagctcaggagcctaagcaacatgatgaatccccatctctacaaaaaatacaaaattagctgggtttggtggctcgcacctgtagtctcagctacttggggggctgaggtgggaggatcacttcggccccagagacggtttgcagtgagcagaaatcgcgccattgcacgccagcatggacagagtgagatcctgtctcaaaaaataataccttaaaactgattatagtaacagatgtaaaactccaaatatacttaaagccactgaattgtactgtattttttattttacttttttataaaaaaattatatatatatattgttttttcttttcttttcttttttcaagacagagtctcactttatcacccaagctggagtgcagaggcgcgatctcggctcactgcaacctccgcctcctgggttcaagtgaacacgtccggctaatttttatatttttagtagagacagggtatttcaccgtgttggccaggctggtctcaaactcctgacctcaagtggcccacccacctcggtctcccaaagtgctggaattacaggtgtgagccactgcacccagccttaattgtatactttaaatgggtgaattgtgtagcgtaagaatttatatctcgataaagctgtttaaaaaaaaaaaaaactacgtaaaaaatgagcaaaggacccgaagagacatttttctaaagaagacatacaggcagccaacaaacatgaaaaaatgctcaacatcattaatcatcagagaaatgcaaatttaaaccacaatgaggtgccatctcacctcagtcagaatgtctgttactaaaaagtctaaaaaaacagatgctggcaaggatttggagtaaagggaccgcttacccactgttgatgggaatgtaaattagtacagcctctatggcaaacagcatggagatttctcaaagaactaaaaatagaactaccatttggtccagtattccactgagtatcctcccaaaggaaaagacatcattatatcaaaaagacacctgcgcttgtatgtttattgcagcactatccacaacagcaaagatatggaatcaacttaagtgtccatcgatgaatggaggattggataaagaaaatgtggtctatatctacaaagatttcatgacgaaattgccaaaagcagtgcagcaaaagcaaacattgacaaatgggatctaattaaactaaaaagcttctgcacagcaaaagaaactatcctcagagtgaacagacaacctacagagtgggagaacatttttgcaatctatccatctgacaaaggtctaacatccagaacctacaaggaatttaaacaaatttacaagaaaagaaaaacctaaaaaagtgggcaaaggacacgaacagacacttctcaaaataagacagtcatgcagccaacaaacatgaaaaaaatgctcaacatcactgatcgttgagaaatgcaaatcaaaacaatgagataccatctcacaccagtcaaaatggccattatcagaaagtcaagaaacaacagatgcaggcaaggttgtggagaaataggaatgcttttacactgttggtgggaatgtaaattagttgaactattatgaagacagtatggcgattcctcaaagatctagaaccagaaataccatttgacccagcaatcccattactggtatatacccaaaagaatataaatcattctattacaaagatacatgtatgcgtatgttcattgcaggactattcacaataccaaagacatggactcaatccaaatgcccatcatggatagactggataaagaaaatgtacaggccgggcactgtggctgacgcctgtaatcctagcactttgagaggccgaggcggcggatcacgaggtcaggagatcgagaccattctgggtaacacggtgaaaccccgtctctactaaaaatacaaaaaaattcactgtgtgtggtggcgggcacctgtagtcccagctactcgggaggctgaggcaggagaatggtgtgaacccaggaggcagagcttgcagtgagccgagatggcaccactgcactcaggcctgggcaaaagagtgagactccgtctcaaaaaaaaaaaagaaaagaaaaaagaaacctgcacatgtatcctggaacaataaaaaaaaaaaagaaagaaaatgtggtatatgtctaccatggaatactacacagccataaaaaaggatgggatcatgtcttttgcaccaacacggatggaactggaggccattatcctgagtaaaatagaaagtcaaataccacatgttctcacttataagtggaatctaaacagcagatacacaaagattggaataatggacagtggagactacaaaaggtgggagggagggaaacaggtgagggttgaaaaattaactgttggaggctgggcacagtggcgcacacctataatcccagcactttgggaggccgacacgggtggatcacgaggtcaggcgttcgaggccagcctggccaacatagtgaaaacccatctctattaaaaatattaaaaaattggccgggcgcggtggctcacgcctgtaatcccagcactttgggagcccgaggcggcagatcacgaggtcaggagattgagaccatcctggctaacatggtgaaaccccgtctctactaaaaatacaaaaaaaaaaaaaaaaaaaattagccgggcatggtagtgtgcgcctgtaatcccagctactcgggaggctgaggcaggagaattgcttgaaattgggaggtggaggttgcagtgagccgagatcacaccactgcactccggcctgggcaacagtgcgagagtctgtctcaaaaaaaagaaaaattgactgttggaagccaggtgcattggtgcatgcctataatcccagcactttgggaggctgaggcgggctgctcactttgagttcaggagtttgagaccagcctgggcaacatggcaaaaccctatctctacaaaaacaaaaattagccgggcactggtggcacatgcctgcagtcccagccactcaagttgcagtgagccaagattgtgccactgcacttcagcctgggagacagagtgagaccctgtctcaaaaaagaaaaagaaaaattaactgttgggtacgctgtttgctattcaggtgatagatatgctaaaagcccagacttcacctctatgcaatatatgtatgtaagaaactggcacttgcacctgctaaaaatataataattttaaaatttttattttaataaaaaaatagaaacttagggccaaggggggagctgatcatttgaggtcaggagttcgagaccagcctggccaacgtggtgaaagcccatctctactaaaaatacaaaaattagccaggcatggtggcgggcgcctgtaatcccagctactcaggaggctgaggcacaagaatcccttgaaccagggatggaggttgcagtgaccaagattgctccactgcaccccagcctgggcaacagagcgagactcagtctcaaaaaaaaaaaagaaacttgagaaaaaatgctatgtaggaggtctgtaggtttcataggaaggtgagagaaagtatattactgaggggggatgaagacaatactcagcctttaaatgttttaaaatgtattttatgaaagtttttttttattgatttattttcagaggattccccccccccaaaaaaaaatcttatgaaaattttggggtgggctgggtacagtggctcacgcctataatcccagcactttgagaggctgaggtgggaggatcacttgagtccaggagttcaagaccagcctgggcaacatagcgagacattgtctctaccaaaacaaacaaacaaaaaatacaaattagccaggtgtggtggtacatgcctgtagtcccagcttgaacctgggaggtcaaggctgcagtgagctgggtggcccactgcactctagcctgggtgaaagtgaggccctgtctgagaaaaaaaatgtagttgaaagaaaagaaaacttttatttttttattttcttttttaattttaaaggcagggtctcactctgttgcccaggctgttcttgaactcctaggctcaagcattcctcccaccttggcctcccaaagtgctgagattgaagtcttgagccactaccctggccatcatgtcaacttttaaacatacaaatacaggtaagaatggcctggtggccgggcgcggtggctcacgcctgtaatcccagcactttgggaggctgaggcaagcggatcacgaggtcaggagattgagaccatcctggctaacacagtgaaaccccatctctactaaaaatacaaaaaagaaaaaaattagccaggcatggtggcaggcgcctgtagtcccaggtactcaggaggctgaggcaggagaatggcgtgaacccaggaggcggagcttgcagtgagccgagatcgcgccactgcactccagcctggtcaacagagcaagactccgtctcaaaaaaaaaaagaagaatggcctggagcctccctcaccttctccacctagacccacttgacaatgggtgacatattttggtttttgctgaaccatttaggagtaacttgagatcatgacattgcgacttcatatcttctgggaaaaatagtgtgtgcacagccacaatttaattatcacacctcggaacatgaacagcaattccaaaatcatatgtaatatgaactcatagtacacgttatagttgtataatagaatagtcattttagtcttccctaaaatgtcttttccaggtggcttttttggaatcaggatgctgcgaagctgcctacgttgcatgcggagcctgcatttcccgtggggcccccttcgtggtggccctgcctggaggtgtctgggtccctcccccacccgactacttcactctctgtcctctctgcccaggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcataggtgagcagggtaagggcgggaggcaaggaggtgggagggccgcggtgtgggagcatccccttgcgggtcagtttctctcttggcttcagctgtgaggttcacattctctgtgggtttccatccatcagcaaatgttcattaagcacctaccgcgtgccagatgcttttctgtgtgctgaggatgtggcaggcaaccaggcattcttgggaaaaacaaaaaaataagtattggctgggcgcagtggcccacccctgtaatcctagcactttggaaggccgagatgggcagatcgcctgaggtcaggagttcaagaccagcctggccaacatggtgaaaccctgtctctacgaaaaataaaaaattagctgggtgtggtggcccgtgcctataatcccagatactcaggaggctgagtcaggagaatcgcttgaacccaggaggcagaggttgcagtgagccgagattgtgccaccactgcactctagtctgggtgacagagcaagactcggtctaaaaaaaaaaaaagtattgaggttgggtgtggtggctcacgactataatccaagcactttgggaggctgaggcaggtagattgcttgagcccatggtggtgcgcagatgtggtcccagctacttgggaggctgaggtgggaggatcgcttgagaccaggaatttgaggctgcggtgagctgtgatcatgccactacactctagcctgggtgacagagtgaggccctatctctaataaataaataaaagagtaagtcaggcagttaaaggggccatggaagttggagagggccaagttgcaattctagctaaggaggtctggggatatttaggcagaaactaggagaggaggagccctctgggtatctaagggaagagcgttccaggcagacggaatggcaagtacaaaggccctgagacaggaatacctggagtatttgagggccaggaaggaagtcagggtggctggagacatatgagtgggggaaagtaggaagcaataaagtcaaggagaggatggggacagattggcaaaagccttgtggactataagaagcctttggcttttgcccagggaggataagagctgtagtaggttcttagcagcagacaggtttgatctggcttgggttctcaccagctcctcctggctgtgttgggaggggaaagaatgggagctgagaaaccacagggtaaggcaactacaaagtccgggtggggccgggtgctgtggctcacgcccataaccccagcactcagggaggccgaggtgggaggatcccttgagcctaggaatttgagaccatcctaggcaacatagtaagactcttgtctcaatgacaaaaaaaattttttttttttttgagacagagttttgctcttgttacccaggctgtagtggagtggcgcgatctcggctcactgcaacctccgcctcccaggttcaaccaattctcctgcctcagcctcccaagtagctgggattacaggctcccaccaccacacctagctaaatttttttgtatttttagtagagacggggttgcaccatgttggccaggctggtcttgaactcccgacctcaggtgatccgtccacctgggcctctcaaagtgctgggattataggcatgagccactgagcctggccaggaaagaaaaaaaaattgttttaattaaccaggctcagtgacttacctgtaatttcagctactcgagagactgaggtgggaggatcacctgagcccaggaggttgaggctgcagtgagctgtgattgtgctactgcactccatcctggacaagagagcgagaccctgtcttaaaacaagtccagtccgggcaggaagtaaaacggcttagaagtaggggacatagtggcctcattgagataggatgtgcagggaaggcgtcttagtcaagtcctggagtctgagaaggagctacctttgggcatagcagaggggcacgggcacagaaacctgggaggtgggcatgagatgggagctgggcgcgttccaggaatggaaagggggctggtgaggataggcaagggcttgggtgaccctcagcggggccacattacacgggcttcacaggtggaggcgaggaggctggactatgccctcagcatggttaagagccatgggaggtgtcaagccacaggagagatctggacaaacgtttgaggttgcaaaaaatgaccggcagcagtatgaggagtgattggaggagtggacggaggtagaagggagctgggacgagaggggagaagaggcattgctgggaagacggatgaggcagtggggggcagagggaagcgggcggcatatagtggtgtttttagaagatagtaggtgctgggcttgcccatggattgagggggaagcaggatcagagaggagtcccaggcctggtgcggtggctcacgcctgtaatcccagcactttaggaggccaaggtgggcagatcgctttgaggtcaggagtttcagaccactctgggcaacatggtgaggccccatctctacaagaaaaaaaaaaattagctgggcatggtagcacacacctgtagtcccagctacccaagaggctgaggtgggaggatcgcttgggcctgggaagcagagattgcaagtgagccaagattgcaccactgcactccagcacgagaccctgtctcaaaaaaaaaaaaaaaaaaataggactcccagcgggaaggtgactgatacttggcaaaaatagagaaggcagggaagattttttttgaaggatgcttttttttcttttcctttttctttttttttttttttctttttttgagacaaagtctcactacattgtccaggctagactcgaactcctgggctcaggggatcctcctacctccgcctcctgcatagctgggattacaggcatgagtcaccacatccagctacgaatgctctttctttaaatcttgaggctgggcgtggtggctcactcctgtaatcccagcactttgggaggccgaggcgggcggatcacgaggtcaggaaatcgagaccatcctggctaacacggtgaaaccccatctctactaaaaatacaagaaattagccaggcgtggtggcgggtgccttagtcccagctactcgggagattgaggcaggagaatggcttgaacccgggaggcggagcttgcagtgagccgagatcgcgccactatactccagcctgggcgacagagtgagactctgtctggaaaaaaaaaaaaatatgttggaagtcccctgggagcccaccttccctaggcaacttcccagaagccacgtcactctggatgccttttcttcccccttctcagcccagagcgtctgagaaggtcaccctgtgctatccttgagtaaacacttccctttccagtaacacatgaaaccacagccgttttccataatacaaaggacagctcttctcctccccaccctcacaaacgcctctcttcttgtgcaatcatttgttctcatccagagataacttcagggctgggcacggtggctcacacctgtaatcccagcactttgggaggctgagaggcaacaagagcaaaactctgtctcaaaataaataaataaataatgagactcagaaaatatgattaagggccaggcgcagtggctcacgcctgtaatcccagcactttgggaggccgaggcaggcggatcacgaggtcaggagattgagaccatcctggctaacacggtgaaaccctgtctctactaaaaatacaaaaaaattagccgggcgtggtggcgggtgcctgtagtcccagctacttgggaggctgaggcaggagaatggcatgaacccaggaggcggagcttgcagtgagccgagatcgcatcactgcactccagcctgggcgacagagcgagactccatctcaaaaaaaaaaaaaaaaagaaaagaaaatatgattaagtgtagggtttaatcaagcccaaagcttgaggatgaccacctgggagcatagattgaagttgccctgaatatacacttcaagcaggggccaaggcaagcagctcttgcaagtgagcttttgtttgtttgtttgtttcttggagagagggtctccaaaactacaaataaaaattagctaggaatggtggcgcacacctgtaatcccagctactcaggaggctaaggcaggcgaattgctgaaaccagcaagggcaggttgcagtaagctgagattgcaccactgcactgcatcctgggtgacagcaagactctgtctcaaattaataaaaaaaaaagagagagagagagataacctcaagagcttccgtatacacactggtgcagaagtaaggaacaaaacagccaaagcctctgtcttcatgatgcgtgagccaccaaggaatagttggccagagtcggcggtcaggaaagtgcccttgacgaagtggggcttggagtggggtctggagaaggaggccaaagcaatccaggcacaaaatcaccaaccaaaaccccaaagtgggtggaggcagagactgaggagggcgtggatggggagcatgtggagtggccaggggaggtggccatggggaagtggtgggctcgggccctgagtcactattctaacagcttggagggcggccaggaggatgtggggaggcttgttggatgctccacgatggtcaggggagaaggcggtgggaagggagagctgggaagaagaggagagtcagaccgtgttgagaagttcagaggtggatacccaggtccagaaagcaacagaagatgtgagtctgggtgggggacacacatcataagcatgagctgctattcttcctggagttttgtttttgtgatttttttccatgttttccaagagaatgaggtggaaagggtataaaaaaaagaaacggctttgagattttctgcctttatcacacttccagtcattcaatcatctaatggtgattacaggaaaaggaacagggggcctttccagctggacctttgaaccacagtactcagttactcgctcggccttgatttgctttttttttttccttttttttttttttcttttggagacagagtctcactgtcacccaggctggagtgcagtggcacgatctcggctcactacaacctctgcctcccaggttcaagcaattctcttacctcagcctcccgagtacctgggattacaggcacctgccaccacgcccagctaatttttgcatttttagtagagatggggtttcaccacgttggccacgctagtctagaactcctgacctcaggtgatctgcccacctgggcctcccaaagtgctgggattacaggcatgagccactgcgcccatcctaatttttgtattttcagtagagatgagttttcaccatgttggccagactggtctcaaattcctggcctcaagtgatccaccctcctcagcctcctaaagtgctggtattgcaggtgtgaaccaccacgcccgaccagcttttttttaaatctcagcctcctctaggcttttggaccctgtctctgcatctctggcagggcgaagagacagtataccgaaatggccaggccaggcgcctgtaacctcagagctttggggagccgaggtgggaagatggcttgtgctcaggagtttgagatcagcctgggcaacatagcaagaactcatctctacaaaaaaatttaaaaattagccgggcatggtggtgcatgcctatggtcctagctactctggaggccaaggcgggaggatcacttgagcctaggaggtgcaggctgcagcaagctatgatcacaccactgcactcgagaccaggtgacagagcgggcccctgtctctaaaaaataaataaagtaaaataaaatgggcaacacttggatagggcagtgcaggccagacattaccctaagccatttacctatcaatgtattatttaattcacacagcaatcctaggggtgggtactttcattatccccattttacaaaacaagaaacagctacagagttgcaaaaccacttatcccaagccaggccgctgataagcagcagagctgggattggaaccccggcagttagggcctaaccaccctgctcctctgctgagtgtttgttgaatgactgccggtgaggagtgacgcaccccctctcctcctctccccagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctgtgagtgtatcgggggtgacccctcccccatcaaaactgcctacactggcttctctaaagcactgtctacattgtctctgaatgttgtctacgtgggttccctgaagccaaattctgcactaccttcctgccattgtctacactggctcccatgggcaaatctacatacttccccctcattgtctacattggctttactgggttcctgcatgctgtgcctagtctgtggtaacctgggatgggcttgcaagagccagtttgatacatttctttccaattccacatccaatgaagtcttctcggtagcttgaaatcaaccttggggaatatttacaccaaggaaattggcaaaccctagaaatgggggcttcttttattccccagagagttggtttaccagcaaagagctgcccccaacagtgtcttttctggctcccatggaccccggttgacactgcccctggaccgttagatcaatcatgctgggccatgtccacatgtctacatgtctacactgcccaacctaacatcgtctccacaccttcccatacttctgccttgacttccctaggtgccatctatactgagtctcccagagtctctacaccgacccctgatccttgatattatttacattgtatttattatttattatttattattatatttttatatattatatattatataaaatatataaattatatattatatattaacatatattttgtcattatttattattgttatttaatataatataattacattatattatatattacattacaggctccaccccccgggccctgttgatcctgacccctcccactgggttttttgctagctcttccagaaactgcctatactcacacctcgtaatgttacccagagaggccaccctggcactcttcacacagaatccctcaaatactggcttaaccacctcttccaccactgtccaaaatgaccacatatcccaactcaatgttgtctacactagctccccaggcaatgcctccacttacacagattccctaagccaagtctacaccagctcccccaggcaacatgcatcacgtgcgcccataagtgcaacagctcccctgagcctcgtctgtgccactttcctcccgggacctacactggttgcccaaaccctgttttgacatcctccctccatgccaaaaacacacacacaggccgggtgcggtggctcacacctgcaatcccagcactttgggaggccaaggcgggcagatcacttgaggtcaggagttcgggactagcctgggcaacatggtgaaaccctgtctgtactaaaaataccaaaattagctggacgtggtggtacatgcctgtaatcccagccatttgggaggctgaggcggagggatggcttgagcccaggacgtggagtttgcagtaaaccaggatcaccccactgctctccatcctgggcaacagagcaagatcctgtctcaaaaacacacacacacacacacacacattatttgtagtggctcccttaggcactgccagcactgaacaataactcccacaaaattatccacagtggtttccctgaacagtgtctacactgacatcagcacacaacagcctggactgatttgccccagacagttttgactgctgtacctcctgccaacccgccccgtttctttagcattcctgtctatctgctaacttgtccacccgctctgggattctcctccttgctgatccagtccccccatttcccccagaccctcctgaagtgtccatctccggctatgatgacaactggtacctcggccgtactgatgccaccctgagctgtgacgtccgcagcaacccagagcccacgggctatgactggagcacgtgagtcacgtggtctcagaaccctgggtctgagggaggcggggctgggggcctggactcctggatctaagggaggaggggctgggggcctggactcctggatctgagggaggaggggctgggcctaaattcctaagtcctccaggatgaagggagcttgcattttggcaatttggggtctccgggagtacttaggtccctggagcttggctcctggtgggtgtatctttagggatgaggcctgtgctcccctctcgaccttggtatccctctcacctgaccccacacccctccaggacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgaggtgagtgggtcttgggggccgtgtgtggagacctgggtccgctcccctggagttctgcccttcaggacttggggctgcactgggggaggctgcgccgccgacctgggagggatgcagacctgcctggctgaggggagatgagggttggccttcccctcgtggcctcagactggggtctggatttggggtgtcggggtaggtgaaggcagcagagttggggggttgaggactttgctcggggttcctagaaagtagaggcctgggtagggtcctcacgaatagacccgaggaagctgccctgggctccagctcctgagaaagacgcacacctagagtcaggcatgcaaacttcaaagagacagaaaccaagagctcccacccccagaaacacaatccggccccaaggcacggagccaaagaggaaaagcacaaagccagaccatcacccagtgatggaaactgggtcaaactcacaactgcagggccacacacctagagcgcggccgggactgttaacagagccatgcttcctgggacagagagacccctgggtcctggagatagggccagagacccctcctgtcagagccacagctggcaggatccacagccacagacactccctgtgctgagaaattctgttgcagagatgcatcagaatccagacactcacctggatggtaaccctgcacgctcaaacccattgtcaccaagacacacacccaggaggacagtggcaccagccaagatagactgaacgaagccagatgacacctggaaagggacattctttttttttttttttgagatggagtctcgctctgtcgcccaggctgaagtgtagtggcgcaatctcagctcaccgcaacctccgcctcccgggttcaagcaattatcctgcctcagcctcctgagtagctgggactatatgcgctcaccaccaaacccggctaagttttgtatttttagtagagacagggtttcaccatattggtcaggctggtctcgaactgctgacctcaggtgatccacccgcctcggcctcacgaagtgctgggattatatgcatgagccactgcgcctggccagaaaaagacattcttagaaacacgccagggcgacggtccatgcagcacacctgtgcaaacacgcaatgtgcaggccccccagaaacatgactgaaggtgtagggacaaactcccagacaggggctgtccctgtcatgcagacagactagccacggagggacagaagcagacccccttactgagtcataatcttagaatgcacacacacttgcagggacacccgagggaaaacagacacctcttcaggaatccagatacagccagggagataggacacccctacgggaaacactgtcacagacagcaaacccagagagacagctgtcccgctctgggctcgcctggcgcgtgaggatgcacataagtccccggaggaagacgtcacacagacacgctgggggcaaaactaatccaggacagcaacggctgcacacggaggaatgtcatccctcactcacagaccctcagacggaaaatcaaagacatcctgggaggagcttcttcccaggaaccctcccgaaactccccgaaactcctccgaaattatccagaaagtccgttagggagattctcattcaacaaatatgtgtttcctgtttgctaggcactcttgctgaggttgggaatacaatggtgaatgagccacagtccctgccctcagtagcacacccaggggagggtcagctccacccgcccagacagacaccgaactggaaatacacccctaacctctaccccagatacacctgacaagctgatcccctgcccacacacccagcaggtggctccaaggtcagagcctgcagaacacagacgcaatagagaaagactcagcgctgtggaaagacacccccacctacccacgacagtggccacagggccacccccagccaataacaccattacaaagacacgtgccttcagataatgcctgcagaaacgtgcatgctccaagcactctagaaatcccgtctcaagcagtgagtgccccgacagccacagccagaggagacacactcaaagctcctggggtcactctcagagggtctctgagccacgaacccacatccaggcacacacagagtcgtcacagagacacagtatggagtccacagcagcacgaacataggatacgaacgccgcaccacaggacagatctatctttagggagactcagagaactttttatttttaatagagacagggtctcgctatgttggccaggctggtcttgaactcctggcctcaaagcattcctccagctttggcctcccaaagtgctgggattacaggtatgagccagcacactaagcctgattcagagctttgaaccctagacatatgaacagactcagcttcgagttccaaaacaccaatgccacctccagaaacagagacaagcctcccaagataggctcaacctggtccagttagtgaccagcacaggagaaaaatctgtttcactcctcaacccagtgtatagttagagacatatataccaccctaccccctaccaaaaaagattttatcctcctttttttaatgctatttgtgagtcactaagctgatttgacagcccgctgggtcatgaccccctgtttgaaaacaacagaaacagatgtccttcctgggtctcagcccctcctgtgtgtcgaggtgtagaggtggggtcaggtgtgggtgaaccccccacccccgtctgtcccagttatgccttgcatgcagggatgggggaagtggatgtgggtaggttctggttacattgacttctgtccctggcttggggcccaggagccccatccctccctgctcacactgccctcctcagcacttcatggcttcctctctctctccgcctccccactacctcccatcccccatccccacctgctcagcccctgcagggagcactaaggaagtcccactgtcccggtctgtgagaaccccattttacacactggggataagtggcctagagatgaggcagccacggcacttggaataaatgctcccagccactcaagagggcagaattatcaggaatctgtggccctctgcagagagctttgggatcagacagcctcccactgaaacccagctgtcctcccccgagggggtgtggcccccaagctcatagctttgtgaggaccccacagcacattcagggagggctgcgaagtcagatggcaccagggtcctggccagtgaccgggcggccagatctattgcatccaaatagccagcttccactcggctacggcgatcgccagacatgggagtttggtgttgctagatctgatttgtccccctaagagaaacctggatttttaagtgaaatcgcctgatttttgaaaggttggctagcaatttaaattttgcaaaacactaacacctggggaccaccggttggcatccccctccttgtacaaagtggtgctcaggctgtagcgaagggcggaggggcttctgcttccccacccccctcctcctcctcctccattcttctgcccagagtcaccccctcattctggtcactcccgctccctccatccccgcctatcctgcatctcccccaccccctcactccccagagcgatcctcgtgatcttgtgtctccctttctctctctctcacccctccttctctctctcctcagaaacccccagggcctcgccccgagatgtgggcccgctggtgtggggggccgtgggggggacactgctggtgctgctgcttctggctggggggtccttggccttcatcctgctgagggtgaggaggaggaggaagagccctggaggagcaggaggaggagccagtggcgacgggggattctacgatccgaaagctcaggtgttgggaaatggggaccccgtcttctggacaccagtagtccctggtcccatggaaccagatggcaaggatgaggaggaggaggaggaggaagagaaggcagagaaaggcctcatgttgcctccacccccagcactcgaggatgacatggagtcccagctggacggctccctcatctcacggcgggcagtttatgtgtgacctggacacagacagagacagagccaggcccggccctcccgcccccgacctgaccacgccggcctagggttccagactggttggacttgttcgtctggacgacactggagtggaacactgcctcccactttcttgggacttggagggaggtggaacagcacactggacttctcccgtctctagggctgcatggggagcccggggagctgagtagtggggatccagagaggacccccgcccccagagacttggttttggctccagccttcccctggccccgtgacactcaggagttaataaatgccttggaggaaaacatcaggggtgtcttgtaatacatcagaccccctccttgcatgttggggaaagagagggtgggacagggactcctaggtcccagggctgggaagagctgatccacgcccccggggaacgagagcctggcaggggttagactggggaaggctgtggggctcggaccacttggatccttgaaagacgcattggatggccgagaaccgcaaggctcgtgcaactaggattcaggtcactggattggggactcagaggcctggacatttggactcctgggtcccaggacagaggctgcctttctggatggtgtggccagacccatcagaggcaggagttctctggactcctgggccctcgggtggaggtgggggtggggacagcaggggctcagccaggttccctgcgtcctgagagaatgaggccagagggctgtgatccagtggagcctcagacctcaactcccccaggttgctgggggtctcgggaggggagggctgctccccactcccattcttaggggccctgagggcatggggcaggcggggggtgctggggaagtcccacctctggccaccccgactgtggctcccctccttctccatccttgcccccagggatcaccccaggggacttttcagtggctccctgggagtggcggcagctccctccagctcctctcaactggaaaagcaaagacggggggaggggcggcccttggtccttgaactcccaggctcagtaagggacaggtttttacccgcgtcacctctgctctcccaagcctccatgcctcctctgtaacacggggcaggtgtttccatcggcctcacaaggctgtcgtgggacccagtaaggacatgcccgtgatgccctcatgcagcctcattgacctccacagaccccaccaagccctgtgccaggcagtgctggggctgcagctgtggcctgcacagacccagtgccgtcctccggtgtgcacggccataatgaccacaagaatagcagcagtatgtttaggatgaaggtgtgtgtgtggaccgaggggcagtctctctctctcactcccccaccctctgaagccctccagaggatgccaggctgtggaacgggagcagtggagatccaacagtccagcgtcctctggaagcttcctcctcatctggagagtgaggccgatgcatgcgtgacccccacgggcccttccatacttgttacttcctctggttgtttgttgtctgtactcacccacccaccccacccggacaaccggagggcaggggcggggaattgggtccgcctggcacacagtggatccttcagtgccatgctgagtcctccttacacacccagcaaacacctactgtgtgccgaacctcaggcacacagtctagtatggaaattggcaagtaaacgggtaaccactccaaaaactcttccattaggaaagacttgagaaatggaaacgggaggtgctagcaaggaaggagaggcccaggagcaaacaggcttctcgcttctcgaccccttttcctgtcttgccttttttttttttttttttttttttttttttgagacggtgtctagctctgttacccaggctggagtgcagtggtacgatctcggctcactgcaccctccacctcccaagttcaagcaattctcctgtctcagcctcttgagtaacgcacccagcctttttttttttaagaagtggggtggtctccctatattacccagattgggctcaaactcctgggctcaagcgatcgatcctcccacttcagcctccaaaagtgctgggatgacaggtgtgagtcactgtgcctggcccctggctaattttttttttttttttttaagacggagtttcactcttatccaggctggagtgcaatggcgcgatcttggctcacggcaacctccgcttcccaggttcaagcaattctcctgcctcagcctcctgagtagctgggattacaggcgcgcgctagcatgcccagctaacattttgtatttttagtagagacagggtttctccatgttggtcaggctggtctcaaactcccaacctcaggtaatccacctgcctcggcctcccaaagtgctgggattacaggcgtgagccaacgcgcccggctagcccccggctaatttttaaaattttttctagagatgaggtcttgtgctcgttgccctggctggtcttgaacaatccgcccgcctcgccctcccaaagcgctgggattacaggcgtcagtcactgccccaagccctaacccccttcctgataagtggaaggagattctagtccccagaggtgattctggatcccagaattctgtccccgcattctctgtcttctagccgcccctggtcctgtctcctctcctctcatcttcccactctgccccgcctcattctgccccagctacacagtctacttgctgttctttaaaaacaatacaaggcaggccgagcacggcataatcccagaacgttgggaggccgaggcgggaggatcacttgagcccaggagttcaagaccagcctgggcaacatggcaaaaccccatctctacaaaaaaattcaaaaaaaaaaaaaaaaagctgggcctggcggcacatgcctgtagttccagccactccggagggtgaggtgggaggatcgcttgagcccaggagattggggctacagttggtggtgatcatgccactgcactctagcctgggtgacaaagcgagaccgtctcaaaaaaaaccatagagccccacaagcctcctgcagggccgctggctgtttgcgctgcctgcgatacccccagacactctcatgactcatccccggtgtctctttcaggcccttgctcagttgtcaccttacagtaaggtagaggccctcccactaccttcggggaccccactttgcacctcctatcacttccgcactgtatatttttgtatcccccgtgacttactcccatctggcatgtgagctattgtactggtttgcttactgttgttctccctgcccaaccagaatcaaagttccatgaaggtagacactttgtatgttttgttctccactcatctcccatgcggggcacacatcctcgctccttcctcatgctcagcagtttgagttgaatgaaagaatgtcccctgcccatgggagaggacatagacaggcaggcgatgatgtggggtgggatggtcgcttggaataaggagctgtggcttcctcctggagaccccctcacgctgtccctctccttgcagagacccccaacacagcaggcgcaggggccacaggcggcatcatcgggggcatcatcgccgccatcattgctactgctgtggctgccacgggcatccttatctgccggcagcagcggaaggagcagacgctgcagggggcagaggaggacgaagagtaagtgatgggccctgagacggggatgggagaggggtcgaagaactgaggagtatggggtaggggtgagggtgggagaaaattctccataatggctgtgtgaaacagacagacctaaaggaactggggtctaaatggagtagggaggtatgggtttctctctgctataaagtatggcattgaatttaaaaattagctgggggccaggcacagtggcttacacctgccatcccagcacttttggaggctgaggtggggagatcgatcgtttgagcccaggaatttgagcccagtctgggtaacataggaagactacccccatctacaaaaaaaaaaaaaaaaaaaaaaaaatggccacgcagggtggctctgaccgctccgctctgcaaagactcctcggagcccaggatcctactacattttttttttttttttgtgacggagtctcactctgtcaccgaggctggaatacagtgatgcaatctcggctcactgcaagctctgcctcccaggttaaagcaattctcctgcctcagcctccggagtagctgggaatacaggcgcccaccaccatgcccagctaattttttggatttttagtagagacagggtttcactgtgttagccaggatggtctctatctcctgaccttgggatcccccctcctcagactccaaaagtgctgggattacaggcgtgagccaccatggctggccagttgttaataaaagaagaaagggcggttcctaaattgttatggagaatttacattaaaataacgtaagctattgattggctatccattgctctttgtatcacaaattccagaaacctgaagataaagagtaacactggtcaggcagggtgggtcaggcagggtggctcctgcctctaatcccagcactttgttttgtttttgtttttgtttaagatggagtcttggtctgtcgccctggctggagtgccaaggcgccatctcggctcactgcaacctccgcctccctggttcaagcgattctccagcctcagcctctcgagtagctgggattacagatgcgcgccaccacgcccggctaatttttgtatttttagtagagacggagtttcaccatgttggccaggctactcttgaactcctgacctcaagtgatccacccgcctcggcctcccaaagtgctaagatcacaagcatgagccactgcgcccagccaatgccagcactttggaaggccaaggctcttgttgctagtggttcgagaccagactgaacatcaaagtgagacaccatctctaaaaaaataaaacaaacaaaattagccaggcaaagtggtgcacacctgtggtccagctcctcaggaggctggggtgggaggtcacttgagcccaggagctcaagtctgcaatgagctatgatcatgccactgcactctagcccaggtgacagagcaagaccctgtatcttaaaaaataaaagactgggcacggtgcctcacacctgtaatcccagcactttgggaagccaacccaagtagataacttgagctcaggagttcgagaccagcctgggcaacatggcgaaacctgtctacaaaaaaaatacaaaaattacccagacctggtagcccatgcctgtagtcccagctacttgggtgggctgaggtgggggtgggggcatgtggaggctgcagtgagctatgatcacaccactgtactccagtctggccaacagagtgagaccttgtaaaaaaaaaaaaagaaaagaaaaatagctcagagcagtctgaggtatgcgagctatgcaaaatttgtttttttgagacaggatctcactctgtccctcaggctagagttcagtggtataatctgagctcactgcaaccttcgcctcctgagctcaaccaatcttcctaccgcagcctcccaagtaaatgggaccacgtaccaccacacctagctagtttttgtatttttgtagagacagggttttgccatgttgcccaggctggtcttgaactcctgacctcaggtgatccacccacctcagcctcccaaagtgctcggattacaggcgtgagccaccatgcccagcctggaatctgtatttaccacaagctctctaagtttttctgatgcacaggaaggtctgttacaccactgtcttaatcatctagttagttcaaaccaataacttgctgctgatctcctctgtgtgcagctccatgctgtgacccactgtgtccgagacggcctggagctcacaatatggaggaggagacaaaactgtctccagatagtgatggtgtagcatgaccagtgatgggatagggcagttgagcaagctctgagaagccagagggggcatctgacccaggctggatggtcaggtagggcttcctggaagaggggacatctgagctgacagaatgcatcgtaagcacctgtcattactgtatgctttggtctgtgggtgtgtagaatgagggacaggaactttaacctaatttgagggacaggaaggcacttcatttattcattcattcttttcacaaatatttactgaactcctcatagtggattctggagacaccttgctgacgacccagatctttcttttttttcttttcttttcttttctttttttttctttttgaggtggagtttcgctcttttttcccaggctggagtgcaatggcgcgatctcggctcaccacaacctccacctcccgggttcaagcaattctcctgcctcagcctcctgagtagctgggattacaggcatgcgccaccacgcccggctaattttgtatttttagtagggacagggtttctccatgttggtcaggctggtctcacactcctgacctcaggtgatctgcccacctcggcctcccaaagtgctgggattacaggcgtgagccaccacgcctggctgatctttctttcttttttttttttttttttttttaatttgagatggcatctcactctattgcacaggctggagtggagtgatctcatctcactgcaacctctgcctcccgagttcaagcgattcttgtgcctcagcctcctgagtagctgggattacaggcgtgcaccatcatgcccagctaatttttgtattttttggggagatggcatttcaccatgttggccaggctggtctcgaactgctgacctcagatgatccgcccgcctcagcctcccaaagtgctgggattacaggcgtgagccactgcccccagcccaacacagatcttttttccctcccagagctcacagtggggcatggtaattataaataacatttcaagtacaaattcagtaagtgccctgagggggaagtacagctaggtatgtccgtgtaacaggaattcctgatccactggggaaacctgaaggcttccgggaaaaagaggaattcatggaatgaataaaaactcttactccaggcaagaaaagggggcaggggaaagggagacccaggtagagggaacagcatgtgccataaccccggagtcagagggatgcctgggtcttaatctccacttgtcctacctcctaccccacagcctggagggacctccctcctacaagccaccgaccccaaaagcgaagctggaggcacaggagatggtgagcactttccctggagcccaagctatccccacctccacacccaccccagggctgggaggggcctggcagggagaagctggctgggtggtgggggcagttcctgacctccccgcccctctcccactacagccctcccagctcttcactctgggggcctcggagcacagcccactcaagaccccctactttgatgctggcgcctcatgcactgagcaggtaggagctcatgggaagacaaaggtgggttgggggtctgggttgaagggccaggggtcaggcctggcaaaagaggtcaaagactaaaggtcataactcaaggtcaagggtgtgtccccggttggtgcttaatgcattgagatgtgttcaggattccatgggggaggtcaggggtgaaaaggcccaaggtcacaaggttagaatttaaagtcacttgggggctgggcacggtggctcacgcctataatcccagcactttgggaggccaaggcaggaggatcacttggggtcaggagttcgagaccagcctgtgcaacatggtgaaaccccgtctctactcaaaacacaaaaaattagttgggtgtggtggtgcgagcctgtaatcttagctacccggggcgctgaggaggaagaatcgcctgaacccaggaggccgaggttacagtgagctaagatcacaccactgcactccagcctgggcaacagagcaagattccgtctcaaaaaaataaataaaaccaaataaataaaatcacctgggccgggcatggtggctctggtctataatcccagtactttgggaggccaaggtagctggaccccttgagcctaggagctcgagaccagcgtgggcaacatgggctacccagcaacattttgcgtctacaaaaatactgaatttacctggatgtggtggcaaatgcctgtaggctgaggtgggcggattgcttaagcccaggtggttggggctgtgccactacactccagcctgggcatcagggtgagaccctatctcaaaaaaaaaaaaaaagaggaaaagtcattaggtcaatgaaaattgattatctggtcaggcatggtggctcacacctgtaatcccagcactttgggaggctgagacgggcagatcacctgacgtcaggagttccagaccaccctggctaacaaggtgaaaccccttctctactaaaaacaaaaataagccaggcatgggtgacatgctcctgtaatcccagctattcaggaggctgaagcaggagaatcgcttggacccaggaggcagaagttgcaatgagctgagaccacgccactgcactccagcctaggcaacagagcaagactccgtctcaaaaaagaaaaaggccgggtgcggttgctcacgcctgtaatcccagcactttgggaggccaaggcaggtggatcacctgaggtcaggagttccaagaccagcctggccaacatggtgaaaccctgtctctactaaaaattacaaaaattagctgggcgtggtggcgggcgcctgtaatcccagctacttgggaggctgaggcaggagaatcgcttggacccgggaggcagaggttgcagtgagcccagattgcaccattgcacaacagcctgggagacaagagcaaaactccgtctcaacaacaaaaaaaaacagaatgaaagaaaattgattatctacatttgctggatactgtgcctgaagctgggacaagacaaatcaagtcactcccctcagtggtctactggaggtcaggggtcagacactgaggttgcgctcaaggttcaaaggactgtttagagcccaaggttaagtatttgaggtcaagactgaggtgaaaggttcatggggaaagatttgcagagatcgagtgtcaaaagtgagtcccaggattaacagggtgagttgcacgagctgggctttgggttaaggaagggctgaatgaatgtcccagtgcaatatggcctcaggggacaaggagtgaggtggcatcttgttggcatggggagagagcggtcaggattttggggtcaagagcagattggtaatctgtgtcgtgcgtaggaagtgatcttgagttcctgtcctctctctacctccaggaaatgcctcgataccatgagctgcccaccttggaagaacggtcaggacccttgcaccctggagccacaagcctggggtcccccatcccggtgcctccagggccacctgctgtggaagacgtttccctggatctagaggatgaggagggggaggaggaggaagagtatctggacaagatcaaccccatctatgatgctctgtcctatagcagcccctctgattcctaccagggcaaaggctttgtcatgtcccgggccatgtatgtgtgagctgccatgcgcctggcgtctcacatctcacctgttgatcccttagctttcttgccaaggatctagtgccccctgacctctggccaggccactgtcagttaacacatatgcattccatttgtgatgtctaccttggtggctccactatgacccctaacccatgagcccagagaaattcaccgtgataatggaatcctggcaaccttatctcatgaggcaggaggtggggaaggtgcttctgcacaacctctgatcccaaggactcctctcccagactgtgaccttagaccatacctctcaccccccaatgcctcgactcccccaaaatcacaaagaagaccctagacctataatttgtcttcaggtagtaaattcccaataggtctgctggagtgggcgctgagggctccctgctgctcagacctgagccctccaggcagcagggtcccacttaccccctccccaccctgttccccaaaggtgggaaagaggggattccccagcccaaggcagggttttcccagcaccctcctgtaagcagaagtctcagggtccagacccttccctgagcccccacccccaccccaattcctgcctaccaagcaagcagccccagcctagggtcagacagggtgagcctcatacagactgtgccttgatggccccagccttgggagaagaatttactgttaacctggaagactactgaatcattttacccttgcccagtggaataggacctaaacatcccccttccggggaaagtgggtcatctgaattgggggtagcaattgatactgttttgtaaactacatttcctacaaaatatgaatttatactttgaccagg

SEQ ID NO: 32 - DNA, 66938 bp, Homo sapiens
tgccaaggctccagcccggccgggctccgaggcgagaggctgcatggagtggccggcgcggctctgcgggctgtgggcgctgctgctctgcgccggcggcgggggcgggggcgggggcgccgcgcctacgggtgagtgcgaccctcggggcccgaggggcggccggagggctgagggcggtgagggtcacggctgaaaggccccggaggtcaacgccgggcggagggccgaagctggggtgggtgctgggggctgccctcgcgaggccccgcgctcggcggctgcggcttcccgcgcgggatctctggggcccggtactggggccggttcgaggtgggacccgggagctgcggggttttcccgaactccgggtgcggcggaggtggcggcagcgaagtaagagggctgcgacttgtagtgggaagagcccaggaggctggcgtccaggcgtgcgggggcggggggcccgaaacatgcccacggcgtcagagggccgtgggtcagcgcccggaatgtcgcctgtgagcccgggaggaaatgaggcgccagagccggcggggaccacgaccgaagtccaggcgagctgagaacgcgccggggctctttgcccgaggccgcgccaatcctcactgtctaagggtggctcttgcgagtggaagttgaagggaacctctaaacatctcagtccttgttgaaaaaggacgtgacgctcatgacctcctctggcgtcgaagaaatcctttgggaaatccagaatagcatcccggcagatgctccccccaccccactctctttaataaaccttatattttagggtaattgtagatttatggaaaagttgcaaagatacttcagagagttgtgtatatccctcaccctgtttggtaacttctagttaatcaacctggcagttgtgaaaaattgggagttaatgacttccttaggagcagctcctggaaggaatggccttctggacgtttttggtgacaatgaaagccccaaactgtataggttttattatcacattgacacaaacacttatatatgcttattgcatttttaccaatgtgctttgaaatccaagttgaaatgttgattaggaaaccttaatgccctctatggattcagtcaataaaatacatgctgccaggcagtgtttaggggctgaggatgcagcagtgagcaaaacagatgaggtgcctgccctcagacatatcggggggtgggggtaaaatatatgatatgtctgagggtgttaagtagagaaaaacagagcaggtgggaaggggtttgccattgtaaaaagggtggatcgagaagaaaacaaatgttgctgaaaggtggcatttgagtagagacctgagggagacttgaagcttgtcagtcaataattattcaggtgtctgccttatttagtactgagtcaggccctctaggttgacttagaacctgagagtgtatagcaaaattcttgccccaaaagggcctctagtttagttgggtacacctgatttccgtaatcatatggggacattgcagtccagagaagggaaggaacttgtctaaagttacccgtctcattagtctcctgattttcacagtgccactccagcaccctccctcctacagactcactcccacacacacctgaaacaacagctggccatctagagaatactggcaactcccaacttcatcagtcctgtcacaatggtttgtcgttagcttgcttatttagaaaacaaacttctttccccattaaaagtattgatagaattgcattgaggtatggtgggaaaaaattagatgtttccagtgagacttgagttttagtggttctgatatttaccacctgtgggactctgggctggtcatttcctctcttttgtgctgcagttagttttctcatctgtgaaatgaggaggttgaactgcataaattctaagagctcctccagctctaatcctcagagtgtttataaaagtgattagattactagcttagtttaacctgtcccactcaatggcccacattgtggcatgtcttaattataactagcatgtatatagcatttatgcccagcagttttctagctgctttacttgtactatttcatttaatctttaccaataatataacttgtaggtgctgttattagtcccattttgtacacgaaaaagttgaggcacagtgcgaccaagacccttgcccaaattcgcatacctggcaaagtggaagagctaggtttccaaccctggcagcctgattccagaggccatgcccttaaccactgtactcattgcttctgcccagcagaaaagacgagagtccttagctggacacctcccagggtagcagggcaggacggcttgggacccacgaaagtatgtgcaagccatttgttaagaagctaatgatactatattaggccgggtgcagtggctcatgcctgtaatcccagcactttaggagactgaggcagatggatcacttgaggccaggagtttgagcctggccaacatggcaaaaccccgtctactaaaaatacaaaaattagccgagtgtgggattacatgcctgtaatcccagctactcaggaagctgaggcatgagactcatttgatcctgggaggcagaggttgcagtgagggaagatcaggccactgcacttcagcctgggcgacagagcaagactgtctcaaaacaaaaaaagaagcgaatgatactacattggagactggctttatagtggctgggctgtgtggtccaaacaactagtactataggcattcaaaagagaaaaagctgacggttggtagtgttatggaagaggtaaaacttgagctagatcttctggatgactgggatttgagtaggtggagaatttattccaggtgggggcaatagcaggagcagagacccagaaatgagggcaagagtgctcctttgtggtcaagaaggaacctggcttggcaggagagtgcattggtaaagtcaatccaggcagaatagcttgatttgcccttgaaagctctgagtccggcacagcatgggaaaaataacacagaaggaggaagcaagcagggagacttcactgggtaggggagcccctggagtgtgaagctacataagaatctatggttgcaggtctccactagaaaaatgtgctgcgaacccttcctgtccaggaccatgacttactggtatcttcccacctggtggggcacaacagagcatatttgcatgattggggtaactaagaaagatgttggaagaaaaaaacgaacaggagttgatgcctgagtggatgtaagggaagggacagatgactcatatatgactcttgtgatttccttaacttttcccaaaatgtgcatgcctctgctagctgctgtgattggacaggcgagagcaaaagctataagctaagcaaaatgccttcttatgaaatagtagattgtgttaactcttaatttaaataggatgttgtgctagatgactgtacagacttgggatttgaggtttagatacagacatacttgggtcccttcctactcccttttctgaagtcagtggtgcaatccccaagacatggttgaaattaggtgcctaagggaagcttatcaggtagaagggatacttgttctgtctcaaaggccagggacacatatcaattcaacagaaaaccaaagcaaccctggccaggcacagtggttcacacctgtaatcccagcactttgggaggccgaggtgggtggatcacttgaggtcaggagttcgagaccagcctggccaacatggcgaaacccagtctctactaaaaatacaaaaattagccaggcgtggcagtgcacacctgtaatcccaactactcggaaggctgaggcaggagaatcgcttgaacccaggaggcagagtttgcagtgagctaagatcacaccagcgcactccagcctgggtaacagagcgagactccgtctccaaaaaaaaaaaaaaaaagcaactctttagaattgttttgtcttaaagaaataaagcagatagctaacacatagcacttgctgcctgtgggcactattctaagcacattgcttgtattaactcatttaatcctcataataaccctttgcaagaggttactattattatcctcatattagagatgagaaaactgagaaatagagaggttaagtaatttgcctgctggcaagtagtagaggtgggatataaactcaggcagtcaggctccagagtctgtgctcttaaacactacactatgttgaagttatacacgaagagctgttagagacctttacaagtagtataatcatcacttaatcatatatatgtctaggcatgttgtatacacacacagttcacatgtatttgtatatatttaaacatttggagattaaagtttcagtgcctgtgtttttttcaattttttattataaaatacacataaaatttaccatcttaatcatttttaagtacacagttcagtgttacgaaatacattcataatgctgtgcaaccatcatcaccatccatccccataactctttttatcttgtaaaactgaaactctgtacccattaaacaataactcctcattttcccctgcccctagcccctggcaaacaccattccactttctatctctatgattttgactactctaagtatctcatatgaatgtaatgatatactatttgtcttttttgtgactggcttatttctgttagcatagtgcccttatggttcatggtgtatcatatgtcagaatttttccttttttaaatttatatatatatatatatttattataccttaagttctagggtacattgcacaacgtgcaggtttgttacatatgtatacatgtgccatgttggtgtgctgcacccattaactcgtcatttacattaggtatatctcctaatgctatccctcccccatccccccaccccacaacaggccccggtgtgtgatgttccccttcctctgtccaagtgttctcaatgttcaattcccacctatgagtgagaacatgcagtgtttggtttttttgtccttgcgatagtttgctgaaaatgatggtttccagtttcatccatgtccctacaaaggagatgaactcatccttttttatgactgcatagtattccatggtgtatatgtgccacattttcttaatccagtctatcattgttggacatttgggttggttccaagtctttgctattgtgagtagtgctgcaataaacatacgtgtgcatgtgtctttatagcagcatgatttatactatttgtcttttttgtgactgacttatttctgttagcataatgccctcatggttcatgttgtatcatatgtcagaatttttcctttttaaaagctgactaatattccattgtatgcatataccatattttgcttatctgtttatctgtcaatggacacttaggttgcttccatgttttagcaatttcacaatactattatgaacctgggtgtagaatatctctttgagaccttgttttcacttcttttgggtatatacccagaaatggaattattgtatcatatgataattctatttgtaatttttttgaggaaccaccatactgttgtccatagtgaaattttaaatttccaccaactgtgcaccggggtttgaatttttccatatcattgccaacatttattttctgttttttgatagtagccattctaatgggagtgaggtgaaatctcattgtggttttggtttgcattttcctaaatattagtgatgatgaacaccttcatgtgcttattggctatttccttatctttgttggtgaaatatctatttaagcctttgcctatttctgaattgaatttttttttattgttgagttttaggcattctctgtatattctggatattaatcccttatcagatatatgatttacacatatttttccattctgtgagtcacttttttctgtgaatattttgatgcacacgttttaattttttccatgaaatccaattcgtcaattttttcttttgttacctacattgttggtgtcatatccaagaaattgttgctgaatccaatggtatgaagcttttgtcttatgttttcttctaaaaattttatagttttagtcttaaaatttcagtctctgatccattttgaattttttttttacttggtattgggtaagcgtccaatttcattctttttcatatggatatccagttttcccagcaccatttgttgaaaagattgtctgcattgagtggtcttggcactgttgtcaaaatcatttgaccatacatgtgatggtttatttctggactgtctattctattacattgatcagtatgtctgtctttatgccagtacacactgttttgattattgcagctttgtagtaagttcagaaatcaggaagtgtgagtcctacagctttgtttttccgtttcaagactgtttggctattcagggttccttgagatttcataagaattttaggatggatttttctatttctgcaaaactatgccattaagattttgataaggattgaattgaatctatatatcactttggatagtattgacatcttaacaatattaagtgttctaatacgtgaacatgggatgtgtttccatatcatctacaaacagagataattttacatcttattttaactggatgtcttttatctctttttcttgcctaattgctctgggtagaacttcaagtactatgttgaataggagtggtgaaagtgggcatctttgtttcattcctgaccctaaaggaaaagctttcagtctttcaccattaagggtgatgtttactgtgggtttttcatatataacttttaagtcaattttcttacactcctagtttgttgagtgtttttatcatgaaaagtaaattttgtctaatgctttttctgtatcaattgagatgatcaggtagttttttcccctttattctgttaatgtggtatattacattgatcaagttttgtatgttaaaacatctttgtattccaggaataaatcccacttggtcatggtctataatccttttgatatgcccgtgtattcactttactgctattttgttgagaatttgtacatcaatgttcataaggcatatgggtctgtagttttcttttcttgtagcgtctttgtctggctttggtatcaggtaatgctggcctcgtagaatgagttacgaagtttgagaaggtttggtactagttctttagatgtttggtagaattttatctgtgaagctatcaggtctagggcttttctttgttgagagatttttgattactgattcaatctccttactacttataggtctgtttagatttcctatttctttgtgatttagttttggtggttttgtgtttctggaaatgtgtccatttcatctaggctgtccaatttgttagtgtacggttgttcatagtactctcttataaccctttttatttctctagaatcagtagtgattctagagaaatactcattttcatttttgaaaatgagtaaagttctcattttcatttttgattttagtaatttcagtcttctttcttattagtccatctagctaaaggtttgtccgttttgttgatcttttcaagaagcttttagtttcattgattttctctatttttctattccctttttcttttatctctggtctaatcttcattatttccttccttatgatagcttaagattagtttgttctttttctagttacgcaagttgtaaagttaaggttgctgatttgagatctttcttgtttcttaatatgtgtttatagctataaatttttccaatagtactgctttcgctgcatcgtctacattttagatgtttatatttacgcctttcatcaaatttgggaagttgtcatccattatttctttattttctttttttgagacagagtctcactctgtcacccaggctggagtgcagtagcacgatctcagctcactgcaacctctgcctcccaggttcaagcgatgctcctgcctcagccacccaagtagctgggattacagatgtgcaccaccacactcagctaatttttgtatttttagtagaactggggtattgccatgttggctaggcttgtttcgaactcctggacccaggcaatctgcctgccttggcctcccaaagtgctgggatgagccaccacacccggctcattattttttcaagtattctttcttcctctttctctctcttctcctggaacccccataatgcatacactggtctgctgatggtgtaccacaggtctcttagactctgttcacttttcttcaatctttttttctttctgttcctcggactcaataatttttattgccctaatttcaagtttattgattctttcttctgcctgctcaaatctacctttgattctttttagtgaatttttcatttcagttgtgctttttctgctccagagtttctttttggtctctttttaggttttctatctctttattggtattttcattttgcttacatatcattttcttgactctctccacatcttcctttagttctgtgaacatctgaagatatttgtttcagaatctttctttaatatatttgccatcaggtctttttcagggacaggtttgctgttgtttaactttttttctttgggccatagtttcctggtttttttgttttgttttgttttgtctgtcttgtgattctttgttagaaactggacatttaaatctggtttctctggaaaccagattcccccttcccccaggatttgctgttttttgttattgttttgtttattgtctttatttttttgattattgtaggctgtctgtgtgttgagcatcaacctgaagtgtaaacttagtcttctcaggtttttttctgggctttccctgagcatgtgtggtcactttctgtttttctctgtatatatagttttgtttcattttgttttgttttgtttttgagacctagtctcgctctgttgcccaggctagagtgcagtggtgtgatcacagctcactgtaacctcgaatccctgggctcaagtgatcctcccacttcagtctcctgaggagctggaactacagattcatgccaccacacctagctaatttaaccaaacaaacaaaaaaaattgttttggtggagatgggatctcgcagtgttgccagggctgatctttaactgctggcctcaagtaatcctcctgcctcggcctaccgaagtgctgggattataggtgtgagtcaccatgcccagcctctgtagttgtttaagaatttctaatctttaatgcctggctcccaaaagtggaaaaggagaaaaatgaggcgacaagggaagagcgccattcttttacatcttctggaaatcactttagctagatagggagggcttgcaacagtggggataggtgcaaccacaatggctgccagcctctttgtctgtacctctgtgatcagaagcagcaatcagtaatcagaatacaaatccctgatatttggaggacagagtacttctgcccacatagcccacaagctgtgggcagagggctccaggaacatgtgcacagccgcctgccatggggttggggatgaaggatgggcagctactactatgtaaaagctgacattgattgaaatttatggcaatttgttgttcaagcctttcctgggaaattgcaagccttcaatgtaagtgtttcctgatataactctgcagtcttccaaaattgttacatcaaacagactctgccactaccattgttatctaggtgaggagatagatgtctggtgcttcctactcttgccttattcccagaatccatgtgtgtgtgtttttaaagtgtaggaagtagaaaaatcaaaagatatggaggaaaccagaagagaaaaagaaaaggatagcagatagccccaggaagcccaaaatgcaaaccagttagaagatctgaccaaaggacacttcaaaacagatgggagaatattaatcccatttgaaaggttgaatatagggcaggccattgttttatttcaaaactgaggttaaagtaggttttaaattaccttgaaaataaattggagtacaattgaaatgaaccacaaataggtatatttttattatcagggctttaatatttgtgtgggagtgggaggtaggtgggtagggagagtactggaagtgctaaactaggtttcttggatgtgtttctgggaactgcagaataaggcagataatcctacagtaaattgtagtctccagtaggaacaatgtttttattggaggctctctacctgacaaatgatttgtcttcaaaaatatcattgatatggtgttagaaaggccaaaatggaatagccatacatgcttttaatcacttaaaatcctaactttagcactgttgcctgagccattggtgctccctggtactagctcagttttaatgcagtgcaataggaattctttgtttccacaaggccttgtcctgctgtgggctgctccttcccacagttggaccttgggaaaaggtagagttagaagagggaatgattttttttatttcaaattttattatagattaaagggtatatgcacagatttgctacatgggtaaactgcatgacgctgagacttggggtccaacaatctgatcacccaggctgtaaccatggtacccaacaggtggttcttcggcccccaaacccacctccctccctcccttgtctagtgatccccagtgtctatcatttccatctttatgatcatgtgtattcagtgtttaacacccacttatgagtgagaacatgcggtatttggttttctattcttgcattagatcacttaggataaaggcctccagctccacccatgttgctgcaaagggcatggtttcattctttttatggctgcgtagtattccatggtatatatgtgccacattatctttatccagtccactgttggtgggcacttaggttagttccgtgtccttgcttttgtgaatagtgctgcagtgaacatacaggtgcatgtgtctttatgatagaatgagttattttcctttgggtatatatcaagtaatggaattgttgggttgaatggtagttctattttaagtccttttttttttttttttttttttttgagacatagtcttgctctgttgcccaggctggggtgcagtggtgcaatcttggctcactgcaacctccacctcctgggttcaagtgattcttatgccacagcctcctgagtttctggtattacagttgtacaccaccatgcctggctaatttttgtatttttagtagagacggtgtttcgttatgttgtccaggctggtcccgaactcatgatctcaagtgatccaaccgcctcagcctcccaaagtgctgggattataggcgtgaaccactgtgcctggcctattttaagttctttgagaaatctctaaagtgctttccacggtggtggaaccagtttgcatttccaccaacagggtataagcattccctattttccacagcctcatcaacatctgttttctgacttttaaataatcaccagggaatgaatgttgagggtcaagggcctttgtagactgctgaccaagtagctgctatgtataaaattgactgttagagaaacctcaactacagagtgtctgtgagtttgatgttttgatgttttgggacaaatggaattttttgctcagttagggaggaaggtaacagtataaatattgctgattatgtaacaggcccagtgcactccaaagtattagcatagagtacaagatttaactctatcatttggtaaattactattactataatccttaagtaattaataatggttccgttcatcactttagaaaatttgggggaattattttcaaataattttaataaacttctatgttgaaataatttttgatttacagaaaagttgcaaaggtgggacagagggttcctgtatacccatcacccagtttctgggggatgattttgatagtctcaggagaacttctcaggaaagtttaaaatgatgtttcacagttcctcctctttctcttccctcttcagattagtcaaagctctagctccagctgtttagtgtcagacctcaggggaacaagggctgctaagtctctttctcagtacttctttggaaaagctataaaaaaacaattaccaggtcatgttagcaagcagaattaaagatgagcttcttaaacttacttatagaactgctgagattttgaacaatctgattttttgttgttgtcattgtttttgagacagggtcttgctccgtcacccaggctagagtgcagtggcatgatcttggctcactgcagcggcatgatcttggctcactgcagcctcaaactcccgggctcaagtcatccttttgcttcagccccccagtacctgggactataggcatgtaccagcatgtttggctaacttttgtaacttttttgtatagatgggattttgctatgttgccggggctggtctcaaactcctgggctcaagccgcttggtctcccaaagtgccaggattacaggtgtgagccgccgtgcccagtctgaagagtctgtatggagtgaggtgtggatcccaaggttagggaaccccaaattcctggaagagaacaacttggaaatattagtatttaagaatatcactcttctctatggaagtggttaagaatgtgaccttggagccacacttttcaagtgacactcccagctctgccgtttactgtagccatgggatatggaacaaattacttcacctgcttgttgcttcagttgcctcatctttaacatgaggccaataggccaggtgtggtggctttatacctgtaatcccagaactttgggaggccaaggtgggcggatcacttgagctcaggagttcgagaccagcctggccagtgtggcaaaaacccatctctactaaaattacaaaaattagccaggcgtggtggcatgtgcctgtagtcccagtaacaggctaggtgaatcacttcaccccaggaggcagaggctgcagtgagctgagatcgtgccactgcactccagcctgggttacaaagtgagattctatctcaaaaaacaacaacaacaaaaacatgaggctaatactagtccctatctccaagattgttgtgaggattaaatggattaatatgtgtggaatatttagaatagtccctggcccagtaaatgttagatgttgttaactcagttattactgtcttgtcctctaggacttgggagaattaagcaaaccattaaaaatactgttgataaattcatttttttttgtccttgatttgaacagaaactcagccacctgtgacaaatttgagtgtctctgttgaaaacctctgcacagtaatatggacatggaatccacccgagggagccagctcaaattgtagtctatggtattttagtcattttggcgacaaacaagataaggtaagttttctgcaacatgttacattgatgaggtaaagtgaacactatgaattggagccaagaataagccaaattctagtcttacgtcaaagtggaaattgtattttagggtgtgtttaaatttcagttggggaaattatagaagcaactattgacacaagtgaacacttaaaaatatttgctaattatttgacaattaaatgcaattgagattgctctgacaggaaatactagatatctttttctctaaggtactcaataaataattatgttattgttaaaatttgttcctatgttcctgcctgtagctgtattgccttgtatctatataacacttaattttggggaatttttacatttaccatcttgctaatcacatggacaaatagatgtacaggcactatgtggtgtaaaagtaaacggccatatggaaagtgaaaaagtaagttgtcagtggcaggtgtgtttgagtagagggttctgtaatgcccgcggaaaaaggaggaagactttcaagatttctagtcaactgatataagtgaatttttgttaataggtttggataatttcaggtcctttatgataatcttattcaacttttttttcaaaatctttttataccttctttcggtgtgtatgtgtttgttgcagggtggcggcggtgagtgggttgggtgtttggggttgaatttgtccaggattttgagtaggcagaatgagaagttattagcaacagtgctttgcatcagtgaattgtagaagcaccaagttcaggcagctttggtggcaggaagtcaggagaactagcttctgattggcactgtcactcttagctgactctatggcctggaataaattgcttaacctctctgagcgtttgtttccttatgtataaagtatggctttactcacttcgctggcttgctgggacacagaaaataatgtatatatacaaaagtttaatagtcaggatggaacatgctcttcctctggagggaaatttgctaatctgccttcctctcccttgtcctgctgaggtgttacttatggtttaggcgttaattgataaagaattgaggcttatcagaagtatttgcattttaaaagaggtcttctaaatgtggaagccaatgatactactagcagtgagactggagtttgcctttacatactgtcggcttcctcttgttcctcctaaggaagggccttaggcatttggagtcttagtggtgatttttggtaattgagccttgagaaattcacagaaagaccctaagtgcctctggctgtaagccctgtaatcacccaagtgtctaactgaaaccctgagcagaggttgcttttcaggtcccttttccttaagttgtcaaggatcaatcaggtagccaggctggtgttctagcctagaaatggggctatttcctcagagtatgtgcagaaatctagagttaaatgtaactttaggagacagtagaatcagatagaattgtgcttgaaattttatctcttcccgtttcaagctgtttgattttgggcaaatcacttaacctctctgagctcccattttcttgtttataaaatatggggttgttttggcggggggcgggtaataatagtaccaactgaatatggatggtgtgtgcattaaaggagatgaggtttgtaatgcacctgacacagagttagtgctaggtaattgttagcttttattattgttactgttgttaggttgagccatgtgaaattaccacttttatgggtcaaaatggttgaatgttgtcagtattatttgtcagcctaatattatcatttaatcttgtttcctccattttacccctgaagaaaccagatagagaccaaaaagggtgacctctgcctaaggccagctcattcattgtagccatttgacagcattgatggccatcagtcctacatttgtgatgaacacggattattccttccagtcagtgataggagatatcctgtctggacctttttcaagtttatcatcaggaggctgaaaatgaatggcagaagtaattttcctctcctctttctgtcctttgggtacagcattagcatcattgggccaaactgaggtatccctgaagcatattgaagcaatggcattatgatagtttgtacattagggggcttaggaaaatgttcaaaggtcccaagttgctaaatgagataaacccttgaggtcattttcaatcttaagattggaggctcatcaagttgagagacagggatttgcagaggatttttggaaaagaaaagattagtgtaaatggcagccctccaccattttttaggcagtgtctaatagttcctcagctggcaagtagaaggaggatctagcatcagattttagatatctttcatcactaagagatgggcaagtcccattaggcaaactaatcaaaaggccaggcatccaaataggaagatgctgaagctaactccctttctttttgagaaaggaattctggagttgagaaaggtgcagtccagccaagtgaacattggtctggggagatcagttcaggactcttgccttggtttttgataaattttcaaagggaatcagattccctgcagggtggagcataacatcatacagcagctaccagtgggaatgattcaccaaagccaaaagtcacatgggagccatcacacatacctcatcaagatctgatgggagggttgaacgtggtgactcatgcctgtaatcccagcactttgggaggccgaggcgggctgatcacctgaggtcaggagttcaagaccagccttgccaacatggtgaaaccctgtctctactaaaaatacaaaagttagccaggcgtggtggtgtgcacctgtaatcccaactacttgggaggctgaggcaggagaatcgcttgaacccaggaggcagtggttgcagtgagccgagatcatgccactgcactccagcctgggcaacagagcaagactgtttaaaaaaaaaatctgatggaaggaatttaggaatttagtttcttgtgtgatacagagaggtgtacttgacttggcagttgttgataatctgggttcctactttattagtgccagtttaatattgtttaccttgaactttgaaagaaattaaaaaaaaattatttgaaaaaattttccctctactgtcccttttctatgttattattcatatgcctgaagcataaggttcggatttagatactaaggcattttttaattttttatgttattttattttgaaatggagtctgctctgtcacccaggctggagtgtagtggtacgatctcagctcactgaaacctctgcctcctaagttcaagcaattcttgtgccttagcctgccaaatagctggaactacaggtgcatgccaccacgaccagctaattttttttgtatttttagtggagacagtgttttgccatgttggccaggctggtttccaactcctgaccttaggtgatcctgacctcaggtgaccttggcctcccaaagtgctgggattacaggtgtgacccaccacgcctggccactaaggcattttttaaattaaaaattccattgtgataatttttgtgtactaaaactccgtaaccctctaactggaacaatgtccattataatatgaaaactgggattatcttcatgatgattctaatttgactgtatttgactgtacagtctaatttgacatttgactgtacattttcccctgatgtcttcaaagggcaaatatagcttccaaacaagaattgccatggatccttggataagggtggcttcttcaaagatatatgggacttgtgcttagtaaaattgtgaggttggtaaaatttgtattcgaagccttcctgccaccactaccatgatcctggaggcaggtcttcagcttcacatactcagaaacttcatttcctcagcacacatgcatctctcaggggctgattttttactttgttgtgaaaatggaatggtaatggtgaagcattctaggaagatttctgttagcataactggtgcatttcatccctgtcggcagagcctatatgggaagccaaatgttaagtaggtttcttggtgaggaatcagaaattagttgtaaaaatatacttgtctaagaatagctggaggccctactgagagtaaacagctttgccagtgggacagaaaaattcaatgcccacattcctgtatcaccctctttttcctgcctgtcaggattttgctcacagacatttctttttctgttcttccagggctgaccaactcccttttcagagtactgtcttgactggacctaagagctattctggttctataaagtgattttgtttttgtgtccttgctatgatttattcattgttgacttggtagttacttctcagaggccatccatatgtcctggttttgggggtatctcacagttgccctcatgctcagctggcagcaggcatgtgacatggcagaatagctctttagggtagcagatagaactaactgtggcaaattttcctcttcatggccgtcaacatgtagatgaaaggaaatactatctctgacttgagtcagaagctattgcaaaacaggaggtgctctccttggagctctgattaaaagcagctccattcttaattattccaactctgtcagtttgggaaatgttaatttcccggagagcccattaatcttattattctcagtcatagtaaccagactggtgatttatgtctctatgatgtctataaattggcttcctatggttccacaaagcttatctacttttcagaatgagagtgtatatactcagcacatatagcaatgtttgaaatttatacatatatatgaggtagtcaaaatagtcaaacagtagagaaagaggtttaatgaaaagtctctcttcagccctcaggccctcctcctttacttccttacccagaagtaaccatgattactggattttttttttgagacagggtctcactgcattgtccaggctagagtgcaatcttggctcactgcagcctcccgctcccaggctcaagtgatcctcccacctcagcctcatgagtagctgggactataggcatgagccaccatacctggccaatttttttttgtacagatggggttttgccattttgcccaggctggtctcgaactcctgggcttaagtgatctgcctgcctcagcctcccaaagtgctgggattataggcatgagccactgagcctggcatgattcctggattcttaaagcatccctttttaaccttaattttcctggtacagtgcatctacttctaagtgaattttgataatcatattgtttcctttaaaattgcttttagagagttgatatgttagcattgtaggtttataggtaaatttcatgtttatacctttaaaatgtgggaaattgttgtatctacaccagggtttctcaatggtgacactagtgacatttgctgaagggtttgttgtaggaggaggggggctgttgtgtgcattgtaggatgtttagcagcgtccttgacctctacttactagatgctggtaacctccccctcccaagttaggacaataaaaagtgttcgatattaccaaatgtctctgagagcggtagggagaacaaaatcagccccaattgagaatcactgatctataccatttgataacttttttgataaaaaaagcaccacatttagacatgctaatgtttcattatataagtgtgtgttagctgaagcaatgcctttttcaattttctaaccttagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtaacaactgaaagcgctatctcttggtgtttagagaataaatctgaatgctccaatgcttttgtgcattgttcattaattaattcaattctcaaacattttctgagtctaataagtgccaggcattgtactaggtgctagcagctcaatgaaaatatgagtatgtctctgccttgaagaagcttacaaacaacttgaataacaatgcctaatagttatataaaatttaataatttaaaaaatgatatacacatgcacgcgcgcgcacacacacactcacacacacacacacgcacacccctcctttagatcgagagtcacaagcttatcttgtgaagtgagtaaggcatgtattattaccctgatccattttatgaggaagaaaggaactgcgtgacttgctgtatgtcttcacatttcaggcccagtgctttaaaaataaaacacaaaatactctcttacccattatgtgtgatacttagtttgatatgcaggatatatttgggaaaagatgttgtttaaagagaaaaatattatgctggcctggctccaatacaagtctagacaagatagtacaagacaaccttaggaaaagctgtcaagtagtgaggatgatcattgttccccaatcccacctctcccaatgtccttctggctcttatgttacatacagggagtagcatatactgattaagagcagggctaccagaaaccaactgtctaactttaaatcccagctctgccagctactagctgtgtaaccttgggcaaatttcttagcccctctgcaccttagtttcctcatctgtaaactgggcatgatgatagtatctatctcctagaattattgggatgattacgtaagtcagtatatgtgaggtacttagaatagtgcctggcaaagagtgaatgttgtgtgtgtgtgtgtgtgtgtgtgtgtgtgtgtacacacacaaaaaacatatatatataacacatatatatactatatataatatatattatatacattatatgtaatatatataatattatataatatataattatatataatattatgttgtcccttggttgggtagggctgggccccatctcttaacctccagtccttagctctatgtgccctttgctctaagccattccatttacctgctttgtactgatcacaaacacatgaagtgctgtttgtaaaattataaaattcaggactgccaggagatttgaaacaacttacctgccctattctcctttccttaggagttaacgaaaaaaaaaaaaaaaaaaacggctagatgcagtggctcacacctgtaatcccagcactttgggaggccaaggtgggcgaatcacctaaggtcaggagtttgagaccagcctggtcaacatggagaaaaataataataattagccaggtgtggtgcatgcttgtagtcccagctactcaggaggctgaggcaggagaatcgcttgaacctgggaagcagaggttgcagtgagccaagatcacatgactgcactccagtctgggtgacagagcaagactctgtctcaaaaaaataataattactatactatgacataaaatggttgatgatggctcagtgtagtaccccttcaaggatcatgagggataacagatttacattttaaacagaggtgtttaatttaaagacattataccttaactaaaatggctttataaagatagagattttaggtcagaaagatactagggctcttaaagtcatgacacttaagaggcaactactaagagttaaattaggcttacctttccccagaattgcttcaggaggaatgtttgtttgtttgtttatttagagacagagtcttgttctgttgtccaggctggagtgcagtggcaagatcttggctcactgcaacctccacccccctggtttaagcaattcttgtgcctcagcctcccgagtagctgggactaaagatatgtgccaccacacctggctattttttgtatttttagtagagacagggttttgccgagttggccaggctgttcttgaactcctgacctcaaatgatccacccttgttggccttccaaagtgctgggaatacaggcgtgagccaccctgcctggctgaatgtttattttttaaaaaatgtgtcagtattgatcaaaagacagaaagttaaattgtacctcaataattttttaagacagatatatataagggttgtttgtatatccacattcatttaggaattgtgtagatattgtctatgattgaaatagtttttgatcttttatctctccctccagttaggaatattagttagggtccctcagtgatagggaagatgttttctttgtatcaggaggtaagagagaaggttgtgaacaaattagatttgagtttcctccatcctgggtgacttctgggtaaaatggggtgagagatgaagcatttgctttctgacaaagcagcatgaagcactctcatcatccccatgccaaagagtgatttgctactttgcattacaaggaaagaagggtcttaaactcttggcctggatattctaggtgatcctgagtctgctgtgactgagcttcaatgcatttggcacaacctgagctacatgaagtgttcttggctccctggaaggaataccagtcccgacactaactatactctctactattggtgagtatgtacagtacaattactggaagactgattgtaattgtgttgggagcctttggatccaacctagtcaaaaaaaaaagaactgtttaattttttctgcaaactcaacaagatggacagtttgcttcaatgaaaaatgcatctgtctttggtgtctactttttaaataaactttctatttttaaatatagatcctgtatattaccagaaaaaatgtacagagagatcccatatactccactcagtttctcccagtggtaacatcttgtgtaactatagtgcattatcaaaaccagaaaattggcattggtacaatccaaaaacctcagtcctatttcaacagttttacatgcactcgtgtgtgtgtatatgtagttgtatgcaattttatcacatgtgaagatatacaatggttgcatcaccataaggagttgctcttttatagccacactcacctccgtcttaaaccatctctccttgtacacccctctcccccaatcctctaacctctggcaaccactaatctgttctccagctctttaattttattatttcaagaatgttactgaaatggaatcctatagtatataaccacttaagactggcttaaaaaaaaaaaactcagcgtaataccctggagatctatacaagtagttgtatatcacgaggccactcctttttatagctcagtagtattccatgatatggatgtaccagttttttaaaccattcattcattaaaggatatctcagttttttccagttttttgctattatgaataaagctactgtaaatattcacatacagatttttatatgaacataacttttcatttctctggaataaatgcccaagagtgcaattgctgggtcatatagtaatggcttatttagtttttttttttaatgccaaactgttttctaaagaagttagttcaccttacatttccactagcaatgcatgagttattgatgtctacttttaaaaaggaaaatgatatgtccggggtcaaaaagttgtttgtttgtttatttatgtttttgagatagagtcttgctctgtcacccaggctagagtgcagtggtgagatctaggctcactgcaacctctgcctcctgggttcaagtgattctcctgcctcagcttcccaagcagctggaattacatgcatgcaccaccatgcctggctaatttttgtatttttggtagaaacagggtttcaacgtgttggccaggctggtctcgaactcctggcctcaagtgatctgcccatctcggcctcccaaagtgctgggattacaggtgtgagccaccacacccagcctcaaaaagtagtttagcttcctgcaaaacaactttgatattttgatatttgatactttagtatttggtatttgtgactatatctactacaaagtttgttaaatttctaagttagtcttccatcattccctttagagcctagaattattagcaacagaacaaggaagaaagaccagattaatccagtttaattcagtaaacctttatttagaacactttgtggataaaccactgaatgcacagcagagacaaaaaacatatctcttctctcctaaagctcaaaatatagaggagaagatagtgcctgatacagtgacctgcattaaattaagtaagacagtgtatgctgaaggctgttgcagagggatagatagattcctgtgggaagttaggttggagcttggggtggtggtcgaggggaggtggatgggtggatggagaggggactgagaggctttgatgaaggaggaagactgcctagatgggggagtttctctgatgctggcctctggggaagagcattttgagaaatggaggtatttaatcgttgtgatgtcagggtggagaaggggagacctagcataggcagtctgcctctacatggccttgttccctgactgtcatttgttaagacttcttctgagagaatgggatgtggagagccatgtccaagacttgtgaagctactggataaacatggcctttcatgctagagtgtctattttgcctgatgacatgatggaaagcatttttgatacattaaaacactcatggctatatcatggaatagaatgcaaaaaaaaaaaaaaaaaaagtaacacacatttttggatgaaaacctccaaagttgccccaggattcacatccgcactcctccctggtggaaggatcctcctggcaaagttgggaaatcctgcaggtggagccagaagttctgtgtggttatgtctgaggtctgtttctttttccccccctgatgtaaatctcatttgaggttttgtagtttcacctgctcactcttggtacctgttgtttctcctttacttaaaacccttcagtggctccctggtggctttaggttaaagtccaaactctccagcatgacagacaaatcgctttatgacagacctggcccctgtcaacctctccagactcggttgcatctgcctccatgcacccccgcccctcttgcagcctaccattcgcccgcagcaaacttctttcagttcctcagactgctttcttcaaatactcaaacacaacactagatttcaaacagaatattcaaacagaatagtggaaacattctgcatcctcttgtagcctaggcctttccttttcatttggatgcctcttatttgtctttatccttatttcagcccagacaccatttcctctccagaaagccttccttgacctctcaagtctagacatgtgtcccttcctcttgtctcacggcaccttgcaatttcttgtgtcatactacccagcacattgtgttgtcatttcctgttacttggtggtagcctgctacaggcttcagtttctcttgagagcgggagctgtgtcttgtttctcctggtgcctgatatatagtaggtattccataaataagttgtgaatgtttggtaggatccaaagctagagaatattcagggttgcggtgatgacttatgaggtataagcaactgaggaatattatggttcatgaataaaaagagagaaggattgagtagatccagctccctaaagaattgctaagaaggggccaaagaactaagccttactaagaaggagtagcctggctgttgatgttgtagtaaagtttagggagagctgttacacaggcttttaagatgtcttgtgagttggcagcatccatgtgtttattatgctattaacccctcttgttttccctggaatcattattggtaaaaccgcagggaaaacctttaaagaatctatgtctatataagggactggaaaagaagggaagaagtcttaaaactgtatctcattccatggcagactgggtagaaaattatcccagctattagaatcagggtggcactggaggcagatggtagcctagtccttggggttcttctaagacaaaaatagggaagtgccttggggatatactagcaaaaacaaagtctcaatgcaaattgttaaaagaatgtttcctctgggtgaatgaattacaaaaaaacctggactgaccaatttgaaaaagcattcctcttcctctgggctgaagcaggctctcaccaaagctgagagcagatggtacttgggctggctttcagccctcagttgatgtctttttgcagggaacaatctgcacagccactggaggtcgctcaagatgcaattccaagatagtggtgggtcactagcatccaagggggcagatatcaaggatcctacttttttttgcgatagggtcttgctctgttgcccaagctgaagtacagttggtgtgatcattgcccactgcggcttcaaccacccaggcccaagccatccccccatgtcagcctcctgagttgctgggatcacaggtgtgtaccaccatgcccagctaatttttgtgttttttgtagagatggggttttgctatgttgcccaggttgctctcgaactcctgggctcaagcccgtctcggcctcccaaagtgctgggattataggcatgagccaccgcacctggcctacttcttgtcatatacagtcccagagctggtcatcagcaggggatctttctgtagtgtagttctgtgccatccagtataggagccactggctacatgtggctagttacattttaatttaaatcaattaaaattgaatcaaattaaaacttcagttgcatagtctcgccaaccactttcacaagtgatgagtggctcttgtattggacagcacagatagcgaccatttccataatcccagaaagttctgttggatggtgctggtatagattctgtatcttatccccttaccaccccacagcttattctttctggagccacactgcttgggttgaaatcctggctctcttccttactttagtgtgattttgggtaagtcccttctctctcagccttagtttcataatctgtgaaatggagatagtaataatagtgcctacttcttaaggttgttgtgagggctagtgtttagagccatgactagctgctagcatatgtagagtaagtgctcaatccataatagctattattactattggccaggcgtggtggctcacgcctgtaatcccagcactttgggaggctgaggcaggtggatcatgaggtcaggagatccagaccatcctggctaacacagtgaaaccccgtctctactaaaaatacaaaaaaatagccaggcgtggtggcgggcacctgtagtcccagctactcaggaggctgaggcaggagaatggtgtgaacccgggaggcggagcttgcagtgagccgagatcccaccactgcactccagtctgggcaacagagcaagactccatctcaaaaaaaaaatactatttattattattattattgttattatccccactcctttgcagatgcagtcagtacacagcgctggcctcttcccgtctcacagaattagtacctaacccatatctccttctttcttgctctcctctagatagatcctttctaatcaaaaccacaaaagaaagggagtcaagacacagtgctcattagcaagcaccagaaatggtttaggtaccagtataaatcacatcaaacaaactgccagagactgttttccctaacccccaaccataaaatacggagtctttcttttttttttttttcttttttttttttttggagacagagtctcattctgtcgccaggctggagtgcagtggtgcgatctcggctcactgcagcctctgcctcccgagttccagtgattctccagcctcaacctcctgagtagctgggattacaggcacgtgccaccacacctggctaatttttgtattttcagtagagacagggttttaccatgttggccaggccggtctggaactcctgacctcaagtgattcacccacctcagcctcctaaagtgctgggattacaggcgtgacccatggcgcctggcctggagtcattttttgaaatcaaaataattcattgaagccctagggcaatgacttgtgtccctgtagggacagtctggcattgaacagaccccggcctgaagagcttcagactagtcatgccagcgaattttagggattttttttttttttaccacattaatcatcttctgagttgggagaatagtctttaatttgtcaatttccttctcatatctgcagtgtgactctgcagatgaattcagtatataaattttaacaggaatcacctgctgttttaggttaatgtttcacaagaattcaagaaatgttatctattcagaaccagtattttcccttctataattatttctaaattacaacaaaattgttttaaaatttcattatctgagatccatgagcatatgcagaatactcagggtacagaaatgaaaaagggatcaagaagattgtgcattcgaggagttcctttcatcattaaaaacaattttacacatggctttctttagttatgtaagaaaaatgtcattaaatttcttcagtttctgtttttggccatgggcggaaaacattccaggacagtctgatccaaaaactagtcatgacaataacttcatttttacaacactgttttcttcataaaccacagggcgctgcaactagggggaaaagcttatgtactacctattgaaggaaaaaagcattttctatatcgaagcattcctttgtgcagcctttgaaggaataaatacattagctctgagtttttttttttttaaactgacttgcagcagaatctcctggagaattgctgttcaaatgctggttcctaggtcctggcaaaaccttctaaatcagattttctgggagagggtttgagaaacctgcattttaaagtagtacagaggattctgaggtaacaggttaaggatttgggactctttactcttagttcatttttcttaaaattgtcttccttttctgcaaaacctttgtgcaactccctttgtggctgatgatgtaagacttgactctgtcttctgccagttactacaaaacagttctctgatagcctagactaaaaaaaaaagtgtaataaacacattgtctgcctgcgctgggctaggtgctgatgatctttggggaaaggtatgtgtcgaggagaaatgggaaataaggtacctgtaatactgcttatggaagacagttaaagccacacagtggagtgagacacttagaaagccattgtgttttagaacattgacctggcagtgattggagggcactaataatgaaggtcagggaggtcaatctgaagaagcaatggagcctgtagtcattagggtatgaatctcagggtgtgggcaatggatgtatcataaaagacgaggatccatgaagctttgcaaaggaagaaagaacagaatttggtgatagaatacagggaacagaggtgggggaaaaggtgattttaatttaaattacctaatctaggagcccaaagaaaatgagctctggctgataatgggaaggttggaagaaaaaacagtttggtggagaagagggtgcatgatgtgttttggacactggatttgaggcaatggtagaacactcaaatggagcagttggagatctgggatttgttctgaggtgagatgtcaggattaggaattaccagcatagaaactgtagttgaaggatgagggagtgataaactggatgtgagtggatgagggagtcagaaagagggaagaatgtgagtagtcctcctactccccctctgctggaagagagaggagggaacagaacaagccaagaaacaaggaaggagcagggcagagggaccagaggaggaatcgtagacttcagcagataggcattttcaagaagcatgaaacttctaatcccagccttagaatgtcttctcttatacagaagaaataggcctcctgtagtctctatagctgctgacagtaccagtgttcatcaaaaaggaacaatctaggctgggtgcaggggctcacgcctgtaatcccagcagtttgggaggccgaggcgggtggatcacttgtggtcaggagttcgagaccagcctggccaacatgctgaacccgtctccactaaaaatacaaaaattagccgggcgtagtagtgtgtgcctgtaatcccagctactcaggaggcatgagattcactggaactcgggaggcggaggctgcagtcagctgagatcgtgccactgtactccagcctgggcagacagagtgagactctgtctcaaaaaaaaaaaaaaaaaaaagcagaaaacagtcttttcttcctagcatatgaaatgagtcacattgtacaatagggtttttttaaaaaaagttatcttgcccattgcaaatattgcttttcatggacatctcagtcattaaaaagaattctgccttttttttttttttttttttttttttttttgtggaagggtcttactcggtcacccaggctggagtgcagtggtgcaatctcagttcactgcaacctctgcctcccaggttcaagagattctccttcctcagcctcctgagtaggtgggattacaagcacctgccaccacacccggctaatttttgtatttttggtagagacagggtttcaccatgttggcaaggctggtttccaactcctgacctcaagtgatccgcctgcctcagcctccaaaagtgctgggattacaggtgtgagccaccgcgcccagcctgctcttatttcttgaatactctgttgaatataatgcagaagattgtctcattttatcttgtaggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtggtaagttttagaagtcctctaaaacagtatggataaaaagtgtgttatatcttttgcacaatcaatacaaataataaaaaatgatcattctgggtttaagatcttctgaaagaagggactatattgatgtataactttctttgatagatcctttttaaagaagtaaacttggaaattctttttattgaacacatgtgccagatgctttatccttgtttagagtacactgagagttagaacagttagttgtagaaccaacattggaattgtcttagttcattttttgtttggtattttctggtattctgttgcttataacagaataccagagactgggtaatttataaagaaaaggaatttatttcttagagttctggaggcagggaagtggaaggtcaaggggccaagtctgatgagtgccttcttgtttgtggggactttctgcaaagtcccaagacagcacagggcatcacatggttagggagttgagcatgctagctcaggtctctcttcctctttgtatacatccacgagtcccactcccatgataatccattaatcggtcaatagatcaatcaattcatgaaggcagaaccctcatgacccaattatctctttaaaggtccaacctctccatactgccacattggggatgaagtttcaacatgagtttgggagaagataaacattcaaatcatagcaggaacccaggccatctgactctaaggtctagtctcttgatacttaaagaggatgatactcataatgatcatatgtagttcctaaataatctgtctcttagaaaaggcatagacttaaggtagtgtaatcgggtgatattcaaaatatttaacattctgtatggcatgggcactgatcagttagaaaaaccagtatagccttaactgtgggtgccagctgcatgtcagcctgttagaaagcaccctcagcttgaacacagattatctgattaggttctaactccttcactttgggcaaggcatataaacccccttcaaatatttccttatctgtgaaatggaatatataatctccctctatctaaaaaaattgtcataaggtccaaatgacataaagcgtattaacacattgtgtaaattactaaagcaaattccattagcgtaatggtttatttgttgaaatatcccaactgggagctcagattctggcttagatagtcatagaagtgaattctaatagggtaccaaagtcagcttactttgtaggccaagggagtgaggttggagtattttgcctagtggggtaagctgaagcagagcccttctctttgtttggcagattatcttagatgatcttttaagtcttattttgctgttttcctctctggatattaatggtgacataaaggaagaaggaagatccttctcagatagaagatgatatcttcaagttgttttctgttaattacccattatcttctattgcttggtcttaagtatagctgactcctgaaaaagtaaattgaccaggctaatgcatttttaaaaataaattatttttttctttttctgagacagggtctctgttgcccaggctggaatgcagtggcgtgatcacagctcactgcagccttgacctcccgggctcaagctatcctcccatctcagcctccctagtacctgggaccacaggcatgtgccaccacgccaggctaatttttgtattttttgtagagacggggttttgccatgtttcgcaggctggtctcaatctcctgagctcaagcgatctacccaccttggctcccaaagtattttactcttaattgtggttataaacacacaacattaaaattaccatcataaacattttaagtgtacagttcggtagtgttaagtatattcacattgttatgcagcagctctttagaactttttcatcttgcaaaaccgaactctgttcattaaacattaatttcccctcccctccgcccttagcaaccacctttctactttctgtttctatgaatttgactacttaagatacctcataggagtggattcatacaatatttgtcttttgtgactggcttattttacctagcataatttccttgaagtgcatttatgttgcagtgtgtgtcagagactaagccaatgttttaatggtggtctttgattggcattaataagtgacaactagggaagccccttgtatctggtgccttattactcatcaggtggaagtacatctggatccaagcctttctttattctctatgttgcgtctagatgtcctgattataccctggccattttctaaccagatgcaggtcagagttcatatcatctgctagataccccaaatatgttccttaaattcattttactaggcagttttaaataaacttcttctataattgtggctaaatagaaattctaaaactatgtatctgatcatgaaaggccactaaatgcatcagctctgttttgatttaactttatgaaccctgcatatatctgcagttgtctctcagtatttgtgagggattgcttccaggaacttccaaggataccaaaatccatggatgctcaagtccctgataaaaagtagcatagtacttgcatataacctatgcatattttctcacatactttaaatcatgtctacattacttataatacctaatacaatgtaaatgctatgtaaatagttgttatattatctagggaataaatgagaagaaaaaactctgtacatgttcagcacagatgctattttttaaaaaatattttcagttcatggttggttgaattcatgaatgtggaatccatggatatggagggccgactgtgtgtttgtgtgtataatcaagctttggaagcttacttgtgttctatttttgtttttcagtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtaaggttttaaaattattgtttttatttggctatttttcttttacttgaatttcttacattgaaatatcaatgaaacatagctcttacatttgtcaccttatgatgatgatggtaatgaaacttcttgtctaaaataaggcatggtggaagatttgaagatttatggtatgatagtatcagctgcaagtttcaagccatttattcatctgtaagcttcttagaaaggcctattaaacgataattcatttgctcaacacgttcttattaaatatccaccacatgccaagcactcttttgtgtgctagggataaggcagtgaacatgacacctgacaagtttttttcttcatgaaacctacataatagaaaacgtaagtaaataagcaagctaatttcagaggatgagtgctgtgaagaaaataaaatgggctgatgtagtagagtgactgggagaacgagagggaatattaggtagggaaatcatctgaggtaataacatttgagatgagaccagaatgatgagcagacgctagccatgtgaagatctgggtgtagggggtcagcagatacagactctgaggcaaaaatgagcttagcatgtgtgagagaacagaaaggagggtggtgtgaacaaaatgtagcaggaaaagatgtctaagcagtaggcagacatcagatcttgcggacactttggaggctctgataataccattctgttttcttggagtttgtggcaactaaagtaatcagatttgagtagtcaatatttgttggattatgtgcctgtatgctattcagaatcaaatgcagaacatgctaattagaggccctgtaggacactgaccagagtgtactataatctcaggacatcagtccagttgttctgctttagggtaaaggtcacaaactagggcctcacacttttttgtgtggaacacaaagtcgtgttttgtttgtttgtttgtttactagatttgaattttttgcccagattttaaatcatagtactttaagagtgtgtgtccataagatggcgccttaagaccatgaagactgcaccactcacttgtctgctacctgcctggaccctttgtgtgtttgagttttagagattagaagtgaagtgttttatattggcttttaaaggagcctagcatctcgcacgtgggtaaattccttggtccagttgttttagctcatcatggaacttccaaaatgcttgctaaaataagccagtgttgacaggctataattccaactccagagggagtgaccaagtccacagcagaacagaacagcaaatgctcttctgggcatttgcattatgaatccttctgctgaaatataataatcattactagtaccagaaattaagtgccccatgaaatgcagcaaagggaaaaatctaagggctttcatgtggaagggggctggtacttgaatttacaacaaaaggagttatcagaaagctgaaatacacttgtttactccagtctttactgttctctcctgtctgaaatcctgagatgcatgtctgaaatcctgagatagtattcattttgccactcaattattttctgctgtttaacctatcacatgtatgcattttctctccactgaaaatatagactcctacagaaaaccaaatgccacatgttctcacttataagtgggagctggacaatgagaacacatggacacatggaggtgaacaacacatactggggcctgtgggggctgtggtgggaggagggagagcatcaggaagaacaactaatggatactggccttaatacctgggtgatgggttgatctgtgcagcaaaccactatggcacacttttacctatgtcacaaacctacacaccctgcacatgtacctcagaatttaaaagttgatattttttaaaaaaagaaaatatagacttctgtaggaaggagtttggtgctgtctactttgtgcagttcctgctactaaatagcagctaacctgtattgagtgattactatgtgctaggtatcttaataagcactatatctgaattgtttcatttaatcttcacaataaccctaaggatctaggtcctgttattttgtctccattttacaagataagaaaacttagttactcctaaggtcacatttttagtaagtggtagaatcaacatttaaccaaagttgtaacgctaagacttggattcttaaccgctagagaacacctcaatacttcctcttaatagcaatagctatcattcattaagtgtttatggcatgctacaaagatgctcttctatgtgcttcttaatacagtagctcatagcaacccatgaaatagaaactattttaacctacattttattgaaaaaactaaggctcagagaggttaagtaacttgctacaagccacacagctaataagtcagtaacacttcaaaggttggttggtctccatgtatttaactttgaccaagaatacttagcataatgtcatgtgcacaatcatcatttaataaattattattgaattgagttactttttttttttttacaaacttctgaactgaagagaacacatacactatggaagttatctacctaaatcagaactattttctatttggaattaactctgtttgtacacttgagtttaatattcttcctcctagcagatgtagaatgtcatcagttttttgtgtgctcacagattttgaactctgctgcttagatttttctttttttttcctttttgaggaattattttgcctggtgttacacttaagagggggaagtaagcgggaacatgaactggtaccaacacatgggggctgtggtcagaggtagctcatgacagaattatgaagtaaggaacaacttgtctgtgaccaccccccaccccccacccccaccttcccagcagactatcttcttggtgccctggctttccttctcttagtggtctctgaagagccagtaaactatgcagggggatttacatttgaacaagagcctagagacgtaaatctacaggttgattcggcaagtttggaatttctatatatgggagatggtccaggggaggagggacatcaatttgcaacttgatccctcactggtagttgacgcttgtgattccccaacaggtctacgattctaaatggccagtaatagggtatactagccccctgagtggggttttttttttctcaacctctgtatgaaatattgaaaggatgtcccttcatcatttgcttggcctctcagctctttacacaggctggtaggaactatttagtgaatgacattgaatgtcaaaaataatatctatgtgttctggtcttggttccaagtttaaacgtctctttgatagaagttgactatttaagcaacagattttcatgtgttttttactccattttggaaatacttgcatttaaggaaattagtattctctttacattagacagcaagtgacttttattgtgtggaggagaattttgcattacactttcttttctccaacccagtcaagttttatatcttatactctcaacaagggacactggtttctcgctccctgtctctttttaaaaagtttttactgagttataatacatgaacaaaattacacaaatcataacctatagctcaatgatttttcacaaatgatttttcacctatgtaaccagcaccacagaagcccccttcagttgctgtcctcccaaagagcagctactctcctggcttctaatcccatagattgattttgttgctactttaaaactttatataaatggaattatatagaacgtacttttttttttcgagacagagtcttgctctgtcacccaggctggagtgcagtgcagtggcgcaatctcagctcactgcaacctccacctcccgggttcaagcgattctcctgtcttagcgtgcggagtagctgggattacaggcacatgccatcaagcccagctttttttttttttttgtattttttagtagagacgaggtttcgccatgttaggcaggctcctggctctcgaactcctggcctcatgtgatccaccctcctcagcctcccaaagtgctgggattacaggcgtgagccactgtgcctggcccagaatgtacttttttgtgtgtttgccctttttttcactcaacattatgtttatgagattcaccaatgttgtttcttatagctgtagatggcacgttctcactacattcattccattgtgtgaatataccatactttatccattctcccattgatggacgtttggatagtttcccatttggttttatgaatggagttcttatgaacgttcacatacttgtctcttggtacacatgtgcgtacatttgtatggggcatttatataggcatatgtgggtcataaggttacatatgattgtctctagtagataataacagttttcctggatggttgtgccagtttacactactaagcagaaattgtgagttctagatgcttcatatcctcacaacacttgttgttgtcaggtaagtgtgtgtattgttatcttgtggatttaatttgcatttttctcatgaccagtgatgttgaacactttttcagatgtttattcgcaacttgcttatcctcttatgaagtgcctgttcaagtcttttgccagtttttttaaaattgggttttctgtttttgccttattagtagggtaagaaaaaatacatatgcaagtcctttgtcagaaattgcaaatatgttctcacactctatgcattgcctgtttatttccctataaggtgtcatttgatcaacaaatgtttttaattttaatatggatgactttattaaaaaattctctttatggttaatatgggaggtttttttggtcttgtttaagaaatatttcccttcttcaaggtcattaagatattctctgtttttatctaaaagcttgctatagttatgtatttattaattcattttatcttacacatttaaatctgcaatatatcaggaactgattttgtgaatagtatgaggtagggcgtcaagaatctttttttttttcatatgcatatgtaattgacccagcaccatttattaaaaaaggccaaccttttttcactgtacctgatcatcttttaatgggataaaaggaaagcttgttagaaatgactaggtgatagaaaatgggtttttaaacatttaggactcattagtttatttatttatttttattttcaaggtccaagaggctaaatgtgagaatccagaatttgagagaaatgtggaggtcagtaaattcaacattagctatttgggtttagacttagagcagttgggggtggagcatagcctaaatatgagctgctttgagaaaaacaaattacgttgttccgtgagttattgacaattttttcgaaaagtcaaagataatttgaattgcaatccaagtcttaatcatagacagaatttggcagataattgtattatgattcaataacagtgaaaaagaataaactggtaatattccttgtgtatttttattttatgcctaagaatacatcttgtttcatggtccctggtgttcttcctgatactttgaacacagtcagaataagagtcaaaacaaataagttatgctatgaggatgacaaactctggagtaattggagccaagaaatgagtataggtaagagaacagaatttttattaaaatttaaaacactgatgtataaaaactaagctgaagcagaaaatagactggggaaagggactgtcatgctctcttgatgtcaggaaaagagtacttacaattgaaatttattttcttcttaatcactttcaaaccacccagggttaattgacagtatacagttatttagaaaaccataatccaaatggttttatgttcttttctatctcatttccatttttattaacaaactgaacaaaaatatagaaagcaggcataggctgcacacagtgactcacgcctgtgatcccagcactttgagaggctgaggcaggaggatcgcttgagcccaggagttggagaccagcctgagcaacatggtgaaaccccatctctacaaaaaatacaaaaattaaccagatatggtggtgcacgcttgtggtcttggctacccaagaggcagagatgggaagatctcttgagcctgggaggcggaggttacagtgagctgagattgtgccactgccctccagcctgggcgacagagtgagaccgtctcaaggaagaagaaaaaaaaaaggcaggcataataaaatttgcacattgtacaatactagagactgtcctacatgctggttggcagaaacaagagtggagccatttaatagaaacctgtacctaagtttgaaaaaaatcatttattaattgaaaggctgagcaagctaggctcaagtacaggactggaaagacctgtgctttatggatgtgtgtgtggtggggtgggatacacggctttataagtgcaatgtgactcaacattgtaatcttaaatgtgtcaaaaaggcatatacaatcttaggagtgataagtgcagcacccagaaaggaatgctgcaggttggggcacagagctatggtcacatcagaattgtgcagtattccattctgagcaccacattaaaggagttgccttggcagactggaatctatccttgaaaggataatcaggatgttgaagaatctcaaaacttggcaaggaacaattggtaaagtaactttgaggagtcatgattgctgatttctaatatttgaggtattgtcaggtacaagaaggaataggctttactttttgtgtctccaaggggcaacacagaaccaacttaagaactttttaaacagctgtatattggtcaaacaggttgtcgaggtagccaattccctattaattgagaagctcaacaagttatgtgccaggcatggttgtattcgtttatttattgttgtataacaaattactccaaagtttaatggcttgaaccaacatacatttaccatctcacagtttcggtgagtcaggagtctagccacggcttagctggaggtctcatgaggttgcagtcaagctgcaatgagaactgaaatatgtctgaaggcttgactggggacagagcatccatttccaagttcactcatatagttgttggaaagcctcagtacctcactggttgctggatggaggctgttgcaggttgaattgtatctcccaaaaaggtatgttcgtaggttccaaccccggtacctgtgaatgtaaccttatttggaaataggatttttgcagatataatcaagtgaggatgaggtcatgctggattaaagtggacagttaatctaatgactagtatccttataaaaagagaagccacacagagacacacagacacacagggaagaaagccatgtgaagatggaggcagagattgcagagatgcagctacaaccaaggaacaacaaggattcccaggagctaccagaagctaggaagaggcaaagagggattcttctctagagccctcagagggagcatagccctgctgacaccttcattttggatttctagcctccaaaactgtgagataatacatttctgttgttgtaagccattcagtttgtggtaatttgcttcccttagttccttgccacttggacctccccatagggctacttcctgacatggaaactggctttcccaagtgagtaatccaagcaagaaacagtgtgagagaacacgcaatatgggaaccatggtcttttataacctaaccttagaaatgacatcccattactgctgctgttctgttttttagaagtgagtcaattagtctagcccatgctcaaggagaggggattacaccagggaatgaatatcaggaggcaggaatcatgtggagaaatcttagtgactgcctaaaacaatggtgccaggccttgatgatgctttctagatgttcatgacctagtgggaaaaatgaatttgtatatagacaaatgacagtctatatgttagatgtagcaaggcaggctttggaattggacagtggaactggaatttgaggcctgatgccattatttactaaatccttccggatgacttactaaacctctctgagccttatctttctcatctgcttaaatgggagataatgctatcattatagcatatatatgagataagcatgcaaaaccacctagtgtggtatcagacatatagtaggtgcttatttaagaataatagtagttgttaggattattttaggtattttagtagtggtaagtaaccagtaaaatatgtagtcactgttaataagattacatatttaatatagcatctttgttaatagtatttaaaactagttaagatcttctgatttacctgagcgggtggggaaacccaccccatgagcatcccctgggctcacccagtgcacagagggaggcctcccgtggctgggcccctctcagtcagcccatgtggctgccatgacctggagcaccacagccgggggcgcccaccagctcaacaccaccacattcacgtggcagcacctccctgcctggcaaccgctgctgttggccagcattaggctgcagctcttcttctacgtgggcctggccttcatcagcctggacctctattactcctccaccagcatcaaggagctggagtacaactacaccggcgacccgggcaccagcaactgctcggtgtgtgctgtggctggccagggctgtgtgccactgcccatctgctcatgcgcctggtacttctcactgcctgagctcttccagggccctgtgtacccctactacgtgctgaccaacttctaccaaaacaaccggcggtatggagtgtccgcgacaacgcgcagctgagcgggctgcccagcacgctgcaccatccagtcaatgagtgcacccactgcgccgcctgcccatcgtgcaccctgcaatgtcatcaccaacagcctcttcaacgactcctcgctgtggcaccagtgctggcccggcgagccctacgtggaggtgccgcgctaccgcactgcacctgcatcacccggtagaccaactaccccatcaagttctgcaacccaccactggtcaacggcagcctggcactggccttccatggcacagcacccctgcccaactggcgctggctggtctacgacaagctcagccccatccccaacaacaacggcttcatcaaccaggacttcgtggtgtggatgcgcatggcagcgctgcccacgttccgcaagctgttccgcaagctgtacgggcacatccgccagggcaactactcagctgggctgccgcggtgtgtctactgtgtcaacatcacctacaactacctggtgcgtgcatttggcggccacaggctccgcatcttcagcagcatcttgtggatgggtggcaggaaccccttcctgtgcatcgcctatgtggtggtcagctccctctgcatccttactggctttgtcatgctggtcatctacattagctaccaggacctaccagaaagatgatgacaatgaggaggaggggtgattccagctttccaacgacccttcctgcttcttaccaaaattctgcaagcttttttcagtctctcccctttgcctctcatcctattccaacctctcctcacttttcctccctttgtgaatgagggggccagagaagggaattacccacttactcttgggggctgctaaactctgttgcctggtggcggagggttgactgcagagtgaaacatccttgcaaactctccccacctccttcatgatgctgagatgccatgttaggttctccaagtccaagagtggaagggatccttatagagactcattttcaacccctaccagaggaagagattgagagacctagcaacatcaaataactcaatcaagatcaggcagctggcaagtggttcctgacgctaaggctagagcttttgccactacagtacagtggttttcttttctttgtggggagggtgggttgggatggagagtgagacccacaaattatctgcagaggcatggaggggtgtgggagaacatatttgttaaatatgcagatagatgaggaggcaccaaccccagagattctgacacagtaatgctggggtgagatgcttgaaactgtgttttaacaaactcctctggagattcctgtattctctcaaatttggaaatcactaccctgaacctggttgggcctgaagcagtcacctgagtccagtttttcagatagtaatttgttcccagggacagtgacaccataatgttgcaggtttggtctggcactctgccttaaatatagtatgctctaatgacttgtggaatgaatttttaaaaaatcactatctctgggctgggcgccatggctcatgcctataatcccatcactttgggaggctgaggcgggtggatcacttgaggtcaggagtacaagaccactctggccaacatggtgaaaccctctctctactgaaatataaaaataagctgggcatggtggcagatgcctgtagttctagctcccgggaggctgaggcaggagaatcgcttgaacccgggaggcggaggttgcattgagtcgagatcgtgccactgcactccagcctgggtgacagagtgagactctgtctcaaaaaaattaaattaaaaaaaatcactatctctggaaaactagttggtgtacagatttgtaggccagggtttgtgtcgatttatttgatattttagtataacagcaaacaggcaaactttaccagatactgtgtagaaatttgaaaatgtgaggccagtttgtacagttcagagggaatgctttttaactgtagaatcagatagctggaagggatctttgagggaaagtaatttccctagtcacatctatgtctcctggctcagtcttctttgtcatttaatctgtgtgtgtgggtgtgtgcgtgcgcacacgtgcgtacttacaaagggcttcattcataccttttctcttggatctggaaaaaatttttttatgttttccaatgagatacatttgtagtaatcatatttgaaacaatgctaaggtatatatagtcttatatgtaaactagaatcttaacattatttgaatcttggagataatgttaaaagtcttagctaaaatgattccattgattttatcgattgactaacatcaatcaatatgtttaaagttattctaagaagcaatatttttatttaaaaaaacctttctttcatggcaaaatagcttaaaagaactttaaaaaaaaaccctatgtgatatgttccagtttatttgctaaaagcaaacagttatttggtatttgtcagacagaattcttcagtacctgctttctattatagctattttccagttaccactcattcgtttatactccttcctttaaagcagcacaagatcttgaagttttttttttatcagttaagaaatattggattgtattggatagtatacatagtttagtctgttagttctctgaaagttactgaacaatggacaatgtgcatgtcactgacatccgtctcagatcttctgggacaactatgatttaagagattctatctcattattacagataccaaaaaaatacttgggtaattccagtgtgttggctttccaactcctgaacactacacaattttattatcagtttttgtatggtgattttaggctatgaaaacattattttatgtacatagagaaatttttattatgaatgtttgagctcactagcccagccctcctctattttgaaaaagagagtttactacattttttactatgtagttgaaaacaacatgtattttgtcatttttagaatggtcagtctatttctataaaattttaaatgtggctgggcgcagtggctcatgcctgtaatcccagcaatttgtgaggctgaggcggacagaacacttgaggtcaagagtttaagaccagcctggcccaaatagggaaaccccgtctctactaaaaatacaaaaattaactcggtgtggtggtgtgcgcctgtagtcccagctactcaggaggctgaggcaggagaatctcttgaaacatggaggcggaggttgcagtgagccaagatcgtgctattgcactccagcctgggtgacagagtgagagactctgtctcaaaacaaacaaacaaacaaaagtttaaatgagaccatcaaatttaagggattctgatccagattaaattaatgaatatggttccaggtcctagtctctgagtttttgaaagagaataaagcttatgtttgtcttttaaaaaatatcctaatttcaggtaatcttttaggtatttgctcgcctagggaagttcaggcaccagaggaggactttttttttttaaactattaatttaacagaagataagataattgaagagcttgggaaaataggttgggggagggagcagaaatatttgtgatcttactagctaacagaattgctgcttggtttattactaaaagggttttatttctcaagtctttctgtttgcttttcattctccaggtaagaagcgcaattccacactctacataaccatgttactcattgttccagtcatcgtcgcaggtgcaatcatagtactcctgctttacctaaaaaggtaaggtagctgcccaggcaggttttgcagtttctgatagcctgtttgctgtggttattacttttagtgcttgtgttttatgtctgcccagtgtattagaagcatgttgcctgtaagtggctttcgggagtatgacatgacaaggaagtattaccacgcccactttcttttcttttcttttttttttttttttcctgagatggagtctctgttgcccaggctggagcgcagtggtgtgatctcggctcactgcagcctccacctcctgggttcaagcaattctcctgcctcagcctcccgagtagctgcgattacaggtgcccaccaccacgcccggctaattttttgtatttttagtagacagggtttcaccatgttggccaggctcgtctcaaactcctgacctcaagtgatccaccctcctcagcctcccaaagtgctgggattataggcatgagccactgcacccagccgctatgcccactttctaatgaaaaccatgttggattagttttccagggctccctgctcaagcactgctgcctttgcatgtgtttaggattgttgaataggtcctatgttcacataatactctttcaaatgcctaatctatcaagttagtcagtagttcttagaatgaagttttagaaatggagacctttactaataaaatgacttgtctggtattaatgcaaagtaggctactacttaatattgtgggaaagagaacttcatcaagttgtcatgaatgtatggtatccattccttgagaatattttattttctctatctcattataggactgttatttgctcttgtagtaaataactaaggttgaaataaggttattaagttggatccagaaccaatattttatcattatttcaacatttattcaacatatatatatactctctctatatatgtatattttttgagtgcctatttgtgaaccaggtactgttctaagtgctaaagttacagcagtgaacaggacaaagtcctcatctacattctagagggaaagatacacacatgcacatacacacacacacacaaaataaataataaatactataatttcacttagaagtataattgacagtagtggggtatggctaggaggtgataggaggtgcattttatgtaggatgtcaccaagaaagtgacatttgaggagagactcccagtaatgtaaaggagtgaatcattcagatattcgaggaaagagcactccaggccatgggaacagcaaatgcaaagtccccaaggctgaaatgcacttggtttgtttggctggagtggagagtgcagggtagagagtggcagcgagggaggacagaggttggccaaccacatcacgcaggccatggcaaggaactgagattttattctaagcatgatgaggagcattggagagttttgagcagagtaggcacatggtctgagttactgtcataaaggattattgtagttgctgagtgaagaactgacttgggcaaaagtggaagccgatggagtagttcggaggcattgcagtgttttggcagaaagatgaggataacctatactagggggttagcaatggagatagcaagaagtggtcagaaatagtatatattttgagagtagaattgataagacttgctgttagttgcctgtctgtggaggtgtgaaggtaattaaggattcagagatacctcttagatttttggcttgagcaactgagtgaatgctggtgccatgtactgagacagagaaggctgtgaggagagctgggtttgagggaaagataaggacttcagttttgcatatgttaagtttgagatgcttattagatatccaaataaggatgttaaataagcgattttgtgcatgaatctggagttgaagggagaggtctgggctgaagatctaattttgggaatcctcggcatgtgaatggatttaaagcctaaagaccgaaaggagtgctcataaagtgaatgagatagacaagaagacaaaaaactgaatcctggggcacatccatggacactcactgggagatggaggcaagctataagattgaaaaatggagagaagtaggaaggaaaaagaaacagaggaatgtatcctgttctcagattattcttttcaaaattatacagagcaagcgcccatctggtctgttaaaagtagagtagcatattatttagatgatagggtataagtaattcatttattctgatggtccctgtgctccacctatgggcaagagtagaacttaatgcccttagaacattgatttttgtgtaccctattttagaaatttcttcacaactgccttgtcaataaagatgacttgtgtaccatgtcttttgtccatgccttcttttaatatggtggtatttatgtgggacactcctatggactggaaggtttgaatcaaatgtctctgttttcttaaaggctcaagattattatattccctccaattcctgatcctggcaagatttttaaagaaatgtttggagaccagaatgatgatactctggtaagaacagatttcatggggcttgaaatgtttttttttttttttttttttggaagctatggcattttttaaaaaagtgtggtaaggtatccataacataaaatttattattttaagcatttttaagtatacagttcaggctgggtatggcagctgacgcctgtaatcccaacactttgggaggctgaggcaggaggatcacttgagcccagcagtttgagaccagcctggacagcatgccactgcacccagctaatttttatatttttttgcgagatctcatttccacaaaatatataaaaattagccgggtgcagcggcatgcacctgtggtcccagctactcaggagattgaggtgggaggatcccttgagcccaggagttcaaggttgcagtgagccatgatcatgccactgcattccagcctggatgacagagcgagactctctaaaaaataaaatatatatgtgtgtatatgtgtgtgtgtatatatatatatatatatatatacacacatacagtttagtgtcattaaatacatttataagttgtacaaccatcgccactatctctttccagaaatttttcatcatcccaaatagaaactgtggctgttaaacaataattccccatcccctcattcctcccacccctggtagcctctattctacttcttgtctctatgaattaaatattctagatacctcctatatgtgaaatcatgcaataatttgtccttttgtgtctggcttatttcatttaccataatgttttaaaggttcattcatgttgtagcatgtatcagaatttccttttgaaattggttcttctaaagtacaatttatttttaaaaatttgaaggagagctgatttaaaatatagtatctgaggccaagcataccagttaaaaagtcttcagaatactttgctcatcttatataactgggctccattctctctctggttaggagacatattttatcaaaacatgcaggaagaagggcctcctttatgaagctagcctaatgagcaggccttctgactcttggataatttaaaaaacttgatgtggggaaatataaacatagggtaagcaattgaaatgcattgtgttcatgttgtttcttggaaggctagactccaaagatatagaaatggagcagccctaccccaactgttatagttggtttcctgcagattctcatgctagaatttgtggccagaaaacctaagacattatgggaacaaaagggtttgaggcttctaactttagttggatttatcatccaccctactgaaataataaagacactaaatgaaataaatattattatcattgtgtatatcttaaaggaataataacaagcatagggcagttaatttagggaagtagtactgcatagtagataatagcctgatttctggagtcagattgtctggattcatatccctgctgtgtcatttaccatctttttgaccttggataattttcttagcttctctgtgactcaattttttcattagtaaaatggaggtaacaatagcacctgcctcatagtgttgttatgtggattaacttaatacccaacagttaattgaatggaaactgcttagcctacctggtaccttgtaagtgcttaataagtgttagtgattagtattactattgataataatttatttttatctttaattcccaaataattattgtaataatgggtgattctcaatggtagtgatgatatttggttagggaaggaaggcagagaggcaaatatgctatcagaagaggattcatttggatcactttttaaccaggtcatcttcacagacagtagataactctgccagaccctgggagtcagggcatgtagacccagaagttaggtacctgatgaggaaattgtatgccgtatctggagcgagtatgatagctatggttctccaactttagttgagtcacagtcaactggagtgcttacaagaaatacagatttctggaccctacttccaattccctgacctgacctgatttggcaggtcagggacgagttctaggactctgcatatttaataggagcccacagatgatccctgtcctgctaagagagtctgtggaccacactttgaaaatcagtgataaagatatttacccctgtctcttacttcatttcaccagctgtgatagatgctggaggttgggaattgtacaagtaccctaacaactttcaccagctattgaaagtctactatgtgtcagacaatgtattaagtgctttgcctatattaccttattgaatcttcataaccaccctatggagaagatgctgttggtattattttacagatgaggaaatggagccccaatgaggttaagcaatttagctgcagtcacacagctagttggtggtaaggtagaatttgacccagggctgtcttaatgctagacttctcttggtctttctactaggctgcattgcctcttgtaagatagaatgcttgttctgaagaacctcaccatcttctaagacatctgtatgacagaagtagagggttggcataggggatttctgagaaaaagatttagggttgtattatgaatagctttaaatgggaagatattggcatgtcttgtatatattaatggcacttttcatgcactgctggtgggcctgtaaaatgatagatatcctttctggagggcaaactggtaaaatgtaacaggaatctttgagcctatgattatacttttaggaaccaattttgaggaaatgatccaacaatggcacaagagtggtcaatgcggcatttgcttttaacatgaaaaattagaagccaatgaaacataacaattgagaattagtttaaaaaaatatgttaggttttcaaagcatttaatgttataacaaaatactcaaaatacaggagtaagaaacttaccataaacatgtagtatattacaatcataatttttatcaaaaatgcattaatatatacatagaacgaggggaaggaaatgggtccgaatgaatgatcatttctaggcaaagggattgtgggtaactgatattactctctctctacctttctaaaatttccagattgcctatagtgagcatgtactacttttataataaaagaaaccctgtacaagtcattaagggaaaaagaaaatactgtagtcatccaggtctgagagataataggaacttgaacttaggtggtagcagaggagattgacgtaagagacattattaaaggaaatcaactcattatgacttggtgagtctgtgtgggtgatgagaggtagggagagtaaaaaataatttcaagttttcaagtctgagtaatagagtgaatgatggtaacattgacagcaaaatcagatcaattatctttctcagagatgggaaaattgcttttttcaatttgctgtctagaggataatatgttgtttttgtcccgatgagtcagataattctgtaatttggtgacgcaaatatactgacaatatggaccattaaaagcacaaggtatttttgttttgtccattgcagaccattaaacaaaatcagttctttaaaactaaaagtataataaaaattccagatatggggaagggtaagagaacaaatttttatgtcggcttttaaccaaatgaaaaaaatctgctttcttcacatggcatcaattctcacaaattgaactgcatatgctgcatactcttttacttctagcatcattgaattattgaatgaacatagccctagaggtcatctaatgaggtggatgttgacatgtttaattatttccctttaattataaatgttcaaaactcgagattctcactcatctccctctctttagagatggggacatgaggagccacagagaagtttctcaaggactgtcactgtgttaagccaatcttgtattgctataaagacatacctgaaactgggtaatttataaataaaagaggtttaattagctcatggttctgcaggcttcacaggaactgtggtgccagcatctgcttctggtgagtatctcaggaagcttacagtcatggtggaaagtgaagggggagcaggcatcttacgtggtgagagtgggaacaagagggggtaggaggtgccatacacttttaaacagctcttatgagaactcactgttgtgatgacagcattaagccatgagggatccacccctatgacccaaacacttcccaccaggccacacttccaacgttggggattacaattcagtatgaaatttggcagggacatatatccaaactgtcagtcacatagagaggcaactgcaaaacctggactagaacccatatagcccaaagttaccaacttccaatccaaataaataatcttgtccttttttaaacactgtcttcttccacactgcaccattaatagttgttcttataaaaacttatttagttatggccatgaataagttaaatcttcagtatagttttccttaaagttactcgtgttttgatgatgttttgttcattactatagtaatgttttggccaacagcatttctttctgttgctttgctatttgccttttccttgtgactaattgggcttctggccatattgaggggaggtaaggggagttgcagagggaattgcttctcctctctatctgcatttctcttatccataaaaaaaaaatctgtcctccccctgcttcttggaaaccaattcttattttcagcattgtgccatttttatattcttgttcagaaaggagctttttaaacatggggataacatccaaatactgctgattgttattttttacttcagtgtgtatcttttttttttcctttttgagatggagtctcattctatcactcaggctggagtgcagtggcacgatcttggctcactgcaaactttgcctcccaggttcaagtgattctcctgcctcagcctcccgagtagctgggactacagatggtgccaccatgcctggctaatttttgtaattttagtagaaatggggttttgccatgttggccaggctggtctcgaactcctgacctcaggtggtccgcccgccttggcctcccaaagtgctgggattacaggcgtgagccaccacgcccagcctcaatatttatctttaaaagctaagaatgctttcctacatagccaaaatagcattactgtactttaaaaattattaattccttaatttcatctaatactcagtccatattcaagtatttccaactgcccaaattgtcaggagacagatattatccagtcatctcaccactgaccactaagacagtggttgagattgaccactatatttaaggtgatacaacagcatgtcccctcctgccatctgcacttatttccccattgcttcaacacagataatctgtgtagtgttatgctagcaccttgtcaagtcttcagctaatgctttttacatcagttgatatccttgcttgaatcagtaatttccttaggggttgggttgaatattacagtttttctctttctatcatttctacatttacttttcttttttttttcttttgagacaggatcttgctctgtcaccgaggctggagggcagtgatgcaacctctgctcactgtagcctcgacctcctgagctcaagcagttttcctgcctcagcctcctgaatagctgggactatagtcacgtgccaccacactcagctaatttttaaatttcttttgtagagacaaggtctcactatgttgcccaggctggtcttgaatttctaggctcaagcgatcctcttgcctcagcctcccaaagtgctgggactacaggcatgagtcaccgtgcctggcccatttctacacttattagctgacaggtatctataaagcgctgctttcagtcatcaactgagctctttagttgttctgaaattcagttcctactaaaaaggcaagatgcatatttaatcatttccctttatttatccattaaggtgaggagttggattaatagacacctcatagtaccaagttattcctctccataccaccacattcaacttggtgtttttttgtttttgctttttttttttgagacagcgtctcactgtgttgcccaggctggaatatagtggtgcaaacatggttcactgcagcctcaacctcctgggctgaggcaatcttctgatctcagcctcccaagtagctgggaatacaggtgtgcactaccacgcccagctaataatttttttttttttttgtatgaatgggcttttgccatgttgcccaggctagtctcaaactcctgggctcaaatgatctgcctgccttggcctcccaaagtgctgggattacaggcatgagctaccgtgctgagcctcaacttgttctttttcaagttgcaatgattttaaggtgtggagatctacaattcattttgtataactttctgttttgaatgataatctgaagagagactggggcatgaaataggtagacttgtataccaaaggccagtgtttttgcatggggctaaggtacatgaagctcacttcacttctgtagacaatccactctggaaaatatcttaaccaaatcttgaaagtaatcttaagttgagacttgatatttcattgtactaccaaatttatgcctttaaattataaaaacctatataacatgccgtttttctaggctcacataattaccaactaaaagccagttgtgtaagccccctaatcactgattttcttcatctatgatgtttttcatctttggccattactctgttgttgattactttgtttttaaaattggcagtaaggattgaattttgggctggtaattgtgtggatttgtttatttttttctacaagtggttttaaaattagacaggcatataattcacagaattgaataataggaaagagccattgcatttatttcttttaccttacatggacatattcatagaagcagtactcaggaaaaggccactgtgttgataaagggtggaaatgagagtaattcaaattttggggatgaaaaaaggcaatcagaaagattaatgtattctgagaagccctttctgttgtagtgttcacctcattaaaacaaattgcttttttcttgtccagcacagccaagtgttggtctaatgaccggaaacaaaagtaattttcagggtgcatttttaatagttatacagtttttatttgtgaaaaatccatattacacacacacacacacacacttcaccactatacattcatgcattttttaaattaaaactttttttttttttctgatcacttgggaggatgaggcaagcggatcacctgaggtcaggagttcgagaccaacctggccaacatggtgaaaccccgtctactaaaaatacaaaattgaccaggcatggtgatgcatgcctgtaatcccagctacttgggaggctgaggcaggagaatcgcttaagcctgggaggcggaggttgtaatgagccgagattgagccactgcactccagcctgggcaacaaaaatgagactctgtcgccaaaaaaaaaaaaaatatatatatatatatatacgtatatatgtatatatatgtatatatatatatatatacgtatatacacatatatacgtatatatattcttttaaaagcaatatacatttagtatagacaaattagaactacagatagtcaagagagaaagacaaaatcactcttaatcctgtcacccagatataactatctttaatggtatgtgaacaacatagggaaactgaaatacctttagtgataaatggagtaatagcaaccacaataataatagttcatacttatggaacctttactatgtgtcttaataacactgtcatattgaattgtatttgaatgtaacaaatgagaattaaaagaatttctgaacttttgatataaaataaattttaatgatgattgaaaagatatttttccatatgctctccccatttgctccccatttttatagttgttgaacatctccattgtgtcctcatatagagccctcatttagtcttacttcagtgtgtggagatacacttgatgctcactaccattttttatgtcaacattgctccagtcatttgggttgtttgaagctggaaagttttctcaggaagtattcatgggaccggcatttcctgaattatttacaaattgatggaatttgctacatttatcattgaaagtcattttggcaaaatataaaatccatggctcataggtcctgcgttgcgtatcttaaatgtgtcatccattttcttctggcataatatgttttgtcagagtcagcagacaatataattttcctcctgtattaaaacacttggtctttttggctggttgtcaaatgatttttttcttcaaagtccaataattttaccagaatatgtgttggcgttgtgattttttgcagtgtatggtgtgctttctcagtatgtaattttagatctttttttttttaattttagtaaaagtttcttcacttacagattttagttattctcttcccatgttttctttgacctttcacatcttttttgttttggcacagggtcttgctctgttggctgggctggagtatggtggcaccatgatagcttattgcagactccaacatctgggctcaagtgatcctcccaactcagcctcctgaatagctgggacaggcatgtgccaccatgcctggctaatttttaaattttttttagagatgcagtcttgctgtgttgcccagtctggtcttgaactactggcttcaagttattcccccacctggaacttccagagttcaggaattataggtgtgagccgctgcacccagcccttccagccctttcacatcctcttgaataattttcatccaccttcatttcatttttgttaaaaaatcctactttttaatctatttaagatcttatctgatgatatgttgtgtttatttgccctgtgtttcttctagcttagtcttcaattttgaaatgattattttcctttacttttattttgttttattttttgagatggagtctcactccatcgcccaggctggagtgcagtggtgcgatcttggctcactgcaaactccgcctcccaggttcaagtgattctcctgcctcagcctcccaagtagctgggattacaggcacatgccaccatgcctggctaattttgtattgttattagagatggggttgcaccatgttggccaggctggtctcgaacccctgacctcaagtgatccacccaccttgacctcccaaagtgctgggattacaagcatgagccactgcgcccagccttcttttacttttaattcttctgtgagttttgtcatccaatttctgagttgtttatattgacttttaatatattcttctacattgattactttttttatatcatgtaactttttaaatatacttcagctagttttgaaatattaggttgtagttttcatctattttgtggatatatcgttctgttatgttttaattctgtaagagtattattctgtggctcatttttattttattctttaattttaaacattttttattttaaaaataattgtcactttgggaggctgaggcagacagatcacaaggtcaggagttcaagaccagcttggccaacatagcaaaaccccgtctctactaaaaatacaaaaaaattagccaggcttggtggcgggtgcctgtaatcccagctacttgggtggctgaggcaaggagaatcgcttgaacctggaggcagaagttgcagtgagccaagatcacgcctctgcactccagcccgggcaacagtgtgagactccatctcaaaaaaaaaaaaaattattatttttgtagaggtggggtttcaccatattgcccaggctggtctcaaattcctgggctcaagcaatcctcctgccttggcctcccaaagtgctgggattataggcgtgaacaaccacacttggcttctgttgttcatttttgtatgaaatcagtttcctgaacttttagaaggaggcttgattgagacaagttgtttctttccctaattttatggctgtagagctccatcctctaatgaattacattctgaaatctcctggccctttctgtctacctttctgctttgatctaggctttcttttttgtcgctcttgtccctgtcctgactaatttgtaatccagtttcaccagtttctcctcagagtgcagctttgccctggaagggattaaggattagttttgagtttctggaggcccaggctgctttcagtctagaccacggactccttgcactcaatcactgtttgaaaatgcaaacccttccctttatcagttgttcataaatttgcttgctgaagttgagttattttacagttctcagatctataggatgccatgttgagtccgtttatatactcttccacagcttataccattttggtcctgtaactatctctaatttgtccacattcactcttactttgaggttcatgggggaaatgttttcatcttgttttgttgtagatttcatcttgtgttggtagattttggatttactttcctattgggggaaccagcccccaatatttcaacgtaagttcttttctattttccctaagtgtcagccggtctgataaataaagggaaagagtacaaaagagagaaattttaaagctggatgtctgggggagacatcacatgtcagcaggttccatgatgccccctaagccgtaaaaccagcaagtttttattagcaattttcaaaggggagggagtgtacgaatagggtgtgggtcacagagatcacatgcttcaagggcaacaaaatatcacaaggcaaatgggcagggcaaggtcacaaggccagggcgaaactagaatttcgcctggttcctggtcctgctgtgcatgcattgtcattgataaacatcaggaaacagggtttgagagcagacaaccattctgactaaaatttactaggcagaaatttcctaatcctaataagcctgagggtgctgcaggagactagggcgtgtttcatctctatctatgactgcataaggcagacactcctagagcagccattttagaggcctcctcctgggaatgcattcttttcccagggctgttaattgctaatattccttactggggaaataattcagtgatatttctcgtacctgtttttggcaataagagaaatatgactgtcctgcccggctccaggcagtcagacctaatggttatctcccttgttccctgaacattgctgttatccttttcttttttcaaggtgcccagatttcatattgttcaaacacacatgctttatgaacaatttgtgcagttaatgcaatcatcacaggggcctgaggcgacatacatcctcagtttatgaagatgacgggattaagagattaaagtaaagataggcataggaagttataagagtattgattggggaagtgataaatgtctatgaaatcttcacaatttatgttcagagattgcagtaaagagaggcgtaagaaattataaaagtattaatttggagaactaataaatgtccatgaaatcttcacaatttatattcttctgtcatgacttcagcaggtccctccgttcggggtccctgacttcacgcaacactttcctatttatatttccaacttgtgtttttttatggtgatatttgggaatattcaaaaacgatgctgctaccaccatcttcttcgcagaatttttctgcaaactatagaccaaggggcaaattctgcctgccacttgtttttgtacagtctttaacctaagaatggtttttgtgcttctaaatagttgggaaaaaaatgtaagaatactatttcatggcacatgaaattaagatttcagtgtcatacagtttcgttggccaggcccattcatttatatattgtctgtggctgctttcatgctacaacagcagagttgttttataggcacagagactatatggcccccgaagctgaaaatacttcttatctagccattttcaggaaaagttagtcaaccctggtcccctataatatagtttttagtggctaaataatattccattgtgtgcacatattataatgtacttaacaaaattcctattggcatttggatgaatcctaaatttcattgtataggcatcatttcacagctaagtataagcatatgtattaatattttattactgtcttaggataaattgttacaagccaaattgcatgatcaagggggagggtatatgtattttaaactctttgactgatacaggctgagtattcctaatctgaaaatctaaaatccgaaatgctcccaaatctgaaactttctaacatgacgttcaaaggaaatgttcattgcaacatttggaatttcagatttttgcgttagtgatgctcagctggtaagtatatagtgcaaatattccaaaagctgaaacacttctggtcccaagcattttgcataagggatattctacctgtattgacaaattgtcatccagaaaggttgtacaaattaaattcccattaaggaaactggctaaataagttatggtgcattcatgcaatgaaatattatgtagaggttaaaatgaggtagatcacttttactgatgtataaaaatataacatacactgttaggtgaaacacccaggttacatatggagagtatgattcctttgtgttaaggaaactggggcattaaaatgcacaaacaaattttttcataagaagcatagattacaactaagttgtgccagttcatatacctaccagcagtatgttcgactggttgtttgaccatacttttgccaatatgatattacctaattttaaaattcttgccaagttaatagatgagaaaagagcgtcttaattttacagtcaggttttgtactttttcccaagtttattggcttgaattaattcttttgtgaaattcttgttccacgtccatttttccttgttgtattcatcttttggtggtttgtaaagctctttacgtattagatattaaccctctggcttcttatccatgttttcctttgtattgtatttagggtgattaatgatgtacaaaaggtttttccttttttatgcagtcaaatcttcctgtatttttaggtgtaaagagccctttccaccttagatttatatagttgttcctctacatatttttctagtacttatttgattttttttaacattgagatctttaatccatcagggatttattcatgtaggctatgaggtagggtttagcattgttttcaaatgcttatattacccacttgtcttagtgtcatttattaaataagccattttttcaaggttatataattttttcaaattgtttttattagaaatctatacatttcacatgttttaaaatcaagtttgaggtgtaatttacaataaaatttactcttttttgagtgttcagttagaagaatgttagcaaatatatgcaattttgtaaccactgctccattaaaaatatagaatatttccatcatctcctaaaagttatcttgtagtcctttgcagtcaaccccctctgttaatcgccttgcaaacactgatcagttttctgtccctaaagtcttacaagatgtcctataaatgaaatcacacagtacatagctttttgagtttggcttcttttactcagcataatgtgtttaagagacatccacactgtggtgtgtgtcagtagttcatttccttttattgctgagcagtattctataatatggttgtaaccacagtttatttaaccattcacttgttcaaggacatcagagttgtatctagtttttaatctattattagtgaaaatgctataaacattcatgtagaagtctttgtgtgacatgttttcatttctcttgggtaaatacctgggagtgggatttctgggtcatgtggtaagtgtatgtgttattttataaccaagtgtcagactgttttccataatgattgcactatcttatttttaccaacaatacatagagatctagtttctctgcgttcttatgagcgcttggaattgtcggtatttttaattttagccattctagtaggtgtgtcagggttatataatttgtttagaataatttgcatattttgagcagtgtttcccaactcatcccctcatctcttaacttgcccagtccatcttcagttgcacaacctgaggcagctcttgtttctgtttttcttctttccatttcttttctaagaacatctgtgcagaaaacgagcttagacataacctaatgcagggtttggtagacttttttctgtaaagggccagataataaatgattttgtttttgcaagccattcagtctctgtcacaactcaactctgccattataacatgaatgcaggtgaaggcaatatgaaacaaagaccagcattcagccggatttgacctgtggaccatagtttgctgacccctggtttagtataacaactttattttacagatgagaggaccgagctcatgtttcaccctttcctctgatttacaagtaaaagtaaaaaaaaggcaaggaccaggatattggcttttaccataagagacatgcttgaattgggttcaagataagtgtgctttatgtgtaatttcctgttctagcaaatgatgttagatgaagctcttaatatagggtctttcggcaatttcgattgcagtaagactttaggaacatcttatgttttaccattcatctcaatgctacttgactttttgaacctattatgtctctggagcaatgagcattaagaaaataaaggtaataaaggtctcagcaaaacagttggagtaagaacggcatgacatccttttattcttcttaatagattttatttccagtggtggaaatgtccaaatttgtttatttctggagatagtcattgtacatcatgtaactatctcatgattcccacctccatttaatattaattcctgattgttctgtttcattaatcattcagatagataaagattcttaggtcaaaaaaaaaaaaaaaacaggaaatcatacccctacggttccatccacacaaacctaaaaataagcattggcactaagtactcagggaaagaacactgtttagatatgtcattgtgtatgtgtttttttcctcccttctagcactggaagaagtacgacatctatgagaagcaaaccaaggaggaaaccgactctgtagtgctgatagaaaacctgaagaaagcctctcagtgatggagataatttatttttaccttcactgtgaccttgagaagattcttcccattctccatttgttatctgggaacttattaaatggaaactgaaactactgcaccatttaaaaacaggcagctcataagagccacaggtctttatgttgagtcgcgcaccgaaaaactaaaaataatgggcgctttggagaagagtgtggagtcattctcattgaattataaaagccagcaggcttcaaactaggggacaaagcaaaaagtgatgatagtggtggagttaatcttatcaagagttgtgacaacttcctgagggatctatacttgctttgtgttctttgtgtcaacatgaacaaattttatttgtaggggaactcatttggggtgcaaatgctaatgtcaaacttgagtcacaaagaacatgtagaaaacaaaatggataaaatctgatatgtattgtttgggatcctattgaaccatgtttgtggctattaaaactcttttaacagtctgggctgggtccggtggctcacgcctgtaatcccagcaatttgggagtccgaggcgggcggatcactcgaggtcaggagttccagaccagcctgaccaaaatggtgaaacctcctctctactaaaactacaaaaattaactgggtgtggtggcgcgtgcctgtaatcccagctactcgggaagctgaggcaggtgaattgtttgaacctgggaggtggaggttgcagtgagcagagatcacaccactgcactctagcctgggtgacagagcaagactctgtctaaaaaacaaaacaaaacaaaacaaaacaaaaaaacctcttaatattctggagtcatcattcccttcgacagcattttcctctgctttgaaagccccagaaatcagtgttggccatgatgacaactacagaaaaaccagaggcagcttctttgccaagacctttcaaagccattttaggctgttaggggcagtggaggtagaatgactccttgggtattagagtttcaaccatgaagtctctaacaatgtattttcttcacctctgctactcaagtagcatttactgtgtctttggtttgtgctaggcccccgggtgtgaagcacagaccccttccaggggtttacagtctatttgagactcctcagttcttgccacttttttttttaatctccaccagtcatttttcagaccttttaactcctcaattccaacactgatttccccttttgcattctccctccttcccttccttgtagccttttgactttcattggaaattaggatgtaaatctgctcaggagacctggaggagcagaggataattagcatctcaggttaagtgtgagtaatctgagaaacaatgactaattcttgcatattttgtaacttccatgtgagggttttcagcattgatatttgtgcattttctaaacagagatgaggtggtatcttcacgtagaacattggtattcgcttgagaaaaaaagaatagttgaacctatttctctttctttacaagatgggtccaggattcctcttttctctgccataaatgattaattaaatagcttttgtgtcttacattggtagccagccagccaaggctctgtttatgcttttggggggcatatattgggttccattctcacctatccacacaacatatccgtatatatcccctctactcttacttcccccaaatttaaagaagtatgggaaatgagaggcatttcccccaccccatttctctcctcacacacagactcatattactggtaggaacttgagaactttatttccaagttgttcaaacatttaccaatcatattaatacaatgatgctatttgcaattcctgctcctaggggaggggagataagaaaccctcactctctacaggtttgggtacaagtggcaacctgcttccatggccgtgtagaagcatggtgccctggcttctctgaggaagctggggttcatgacaatggcagatgtaaagttattcttgaagtcagattgaggctgggagacagccgtagtagatgttctactttgttctgctgttctctagaaagaatatttggttttcctgtataggaatgagattaattcctttccaggtattttataattctgggaagcaaaacccatgcctccccctagccatttttactgttatcctatttagatggccatgaagaggatgctgtgaaattcccaacaaacattgatgctgacagtcatgcagtctgggagtggggaagtgatcttttgttcccatcctcttcttttagcagtaaaatagctgagggaaaagggagggaaaaggaagttatgggaatacctgtggtggttgtgatccctaggtcttgggagctcttggaggtgtctgtatcagtggatttcccatcccctgtgggaaattagtaggctcatttactgttttaggtctagcctatgtggattttttcctaacatacctaagcaaacccagtgtcaggatggtaattcttattctttcgttcagttaagtttttcccttcatctgggcactgaagggatatgtgaaacaatgttaacatttttggtagtcttcaaccagggattgtttctgtttaacttcttataggaaagcttgagtaaaataaatattgtctttttgtatgtca

SEQ ID NO: 33 - DNA, 42218 bp, Homo sapiens
gcgagcgcagcggagcctggagagaaggcgctgggctgcgagggcgcgagggcgcgagggcagggggcaaccggaccccgcccgcacccatggcgcccgtcgccgtctgggccgcgctggccgtcggactggagctctgggctgcggcgcacgccttgcccgcccaggtgggtgactcgcgcggcccacgggggacagccgccccgcatgtccacccggctggtgcgcagccttcgggtgcccgggccgcgctctcccggggcgctgtcacgggctgggaggctgggagtcccagtcgccgccccccatccgcatcagacacgcgcgcctctggggacccgctggggactccgggcccggcacacgtgcgctcggggcacaactctggcccccgaagcccctcttacccgcgtcgtgacaggggcgcaccctggttcctccgcgagcgcaggccggggcatttggggctgagcagcgggtcctgggcagacccccgctagacccgggacccctcttccctcaccccggcgactgccgcgacagcccttccctcccacgcggtggagaaggggctgtgccggggcgctgccccactgcccacgccgggcaccctcttcaaaagacttccttttcctctgggcgacggttttccgatttcttagaaataccagggtcctgtgtctgaagagcaggaccaggtgtgtgtcaggtccactgagggcacagctggagggcgagctgcctgtctgcttcctccgatgcgtccgggggctactgcagagtctgttttctgcggcctctggggacagggcaagcgagggaggtctgggctggtaatcgagcaaggcaaatgaagtctccgggggccgcaggaaaatggagacagcagaaaccctagggctcctattcaatatgaacgtcactcccacagtagcaacgggcgtacaagggactgtgcaccctttgcctgtttttgactgtctcctggtctggtaacataggataaccccatttttgttttactgtctccatggtttggtaagataagataaaccattttttagagaaggaaaactgaggctcagagaacttgtatttcatggaagggtctggggggaactcttcctccaaagggggcctctcctgccttcggcccctgtgccctgaggctgcggggaaggtgggcgttcatccttcctcagagccgcccctgatggacacatggcccatctgcccccatctgacatcttgaccgaggaggaaggtgggaggtggcactggcttctgtggtgacataaggtgacttgttgatctgaggccagagagtccagttcttgtgggtggaagatgggggctgtcagactagaattgactcaccgacagtgggtgtcaggagtgggtcctggagaactgccccagagtaagtcctgggtggcctttgggtcaggagagtccccactctagggccgagtgtgaatggggacgaccgtggtccccagcttgactttggggtcatgccatatactctggcctcagagggggtcttcctgccgctgagcttgggcctgcctgggtgaactctggggtcatgtgagcccctggatgggagaggggtgtcaggcacagggctcagcaggacaccaggctgcagtcctggagtagctggaggaggttccctcccacttccttcccttcctgaccagctcctgcggcagctcatattccctcctccctcatccctgctccccacgaccccacccggactattgccgcagccttgtagctggtctcccggccctgccccctctcccgctgatccttggcagagagacccttctcaagcatgaggcacctctctgtttgcctggggagcctcctgtggctcccaatggttgaggcagaaactcccctggagatcccaggccagagtaaggtacctgaactcttcctcgcgcctccctgcacatgtgctcccccgcctctgtagaactgatgatggtcatcgtgtgtgtcattgtgcaaaaagcattgtccgtgccatcccctctccaagggacacttcttacccctatccttcaaggccttctgcaaatgccattctctccaggaaagcctttccgcattctcagttggatttgatcttctcttcgaactcccaggcccttttgttccctttgaggacagattgcattctgctttttaatctagctgtgttttatccccctcagtggatggaaggtgtcttcagggccagaactgtgggttcctcttccttctcatcagtagcatcgccatagctcctgatttctgaacacccactaaacaccaggcactgggctaggtactttgtcacaaaatttcactgaaacctcccttacagcaactcccaagaggtgggtggtgccgtttgtctttagagatgtggaaactgaggcgtttcccaggatcacagagctgggggccggggagctgggggtgggatttgaatgcaggtctgcctgattcccaagctcctttcactgcaccctccccgtgcccgtatctgcactcatgctcccagccaggccctcacacacagtgggttctcaggatggaagtcaactgagctgcagaagaagcccccaggagacctgagctagccatggacgcagccgactcactgccagcagggcttttgccccgtttaaaagtcttatttgccagctggtatggaaaacatcattcattcatttagccatttattcatttgacaaagaaatgccagtaaacctggcagtaggtgagtgcttggtgccctctgatggggatgagcagggtctgggctgtctggggaggaggatgaggggtctctgcctgatgggcctggcccacctacccctggaagtcttggtgctgaggtgccactatttgcctcctcatcacccagggcctggggccagtttgggttaggggagaggttgggggctcccaggctggatgtcaaagaggagttgggtgatctggggtacctgctggccctgggggctcttccctccttccaccacgtctctgtctctttgccctctgtctgaaatcccagtggggaccctgtgtgttgactgagggtgtggtctgttggtcaggcacgtcttcagagggcaatgggtaggtggccaggcaccctgaggcagggccattcattcattcattcattccccaaagttcatggacacacctagtccaagcccagcccagtgcctggctctggggacctcaagatgactccagctccaatcctctaggagctacactaccaataggtcacagacctcacagacctgggctctgtcccaactgcccttatgagcttagctgagctagtaagcctatgttctcatctgtggttgtggaaagtattccctgcctggcctttgtcacagagccatgggtgtgaaaggctgagaacctgccgggcattcttacgtcagaggtgaccctgccatcctggcacctggcacagtggctccccgtagcactgtccctccccacggctgggtgacgctttatggtccttactatgcaatgttttctggaggagtagcagggacggttgtgcgtgggaaggggaagagttttgccggagccatggcatgtatgttacacccgactctacaccaactcacttcttactttttttctgagatggagtcttgctctgttgctcaggctggagtgcagtggcgacatctctgctcactgcagtctccatctgcctcttgggttcaaacgattctcctgcctcagcctccagagtagctgggactacaggcatgcaccaccatgcccaactaattttttttttttttgtatttttagtagagtcggggtttcaccatattgcccaggatggtcttggacccctgacctcaagtgatcctcccgcctcagcctcccaaagtgctgggattacaagcatgtgccactgtgcctggcccgttctcacttcttcttctttttttctatttaatttttttttattgagatagagtcttactctgtcacccaggctggagtgcagtggcccaatctctgctcactgcaacctccacctcctgggttcaagcaattttcccacctcagcctcccaagtagctgggattacaggtgtgtgccaccatgcccggctaatttttcctttttttttttttttttagtagagaccgggttttgccatgttggccaggctggtctcgaactcctgaactcaagtgatccacctgcctcggcctcccgaagtgctgggattataggcgtgagccaccccacccagccccattctcacttttaagccatgcttttctgtcctcagatgtgctgcacacacacctgctccagggcctttgcacttgctttccccatcacctccaatactcctcctgctgacgtctcttggtctccttccctcgcttccttctgctgaagtagacaatcctgcctgtaggtgctccctgccaggcactctcactccctgacctgctttgtattcctgtataatgctcttgacctattctatttatttcacttttattatgtcttcccacaagattgtaagtaccgtgaggacagggactcattcaccactgtagactctagcctagaagagggtttttcagtcagtgcctctgactttaattctttgttgtggggctgtcccgtgagctgtaggatgtttagcgacatccctggcctctacttattggatggcagtagcgccaccctccctcgtgacaaaaatatctccagatattgctaagtgtcctttggggttgggggattgcccctgattgagaaccactggcctaggacagtgcctggcacatagtaagtgttcaaaaaatattcatctgaccttgaccttgataatggccctgttttacagatgagacgggggtttgaaaagtcagtggtggcagggtggggttctgtttgcctccatctcttggggtatttttctgggctcctcttcccattgagtggtgtctgctgaggttaggggtcctctccccaaattgctcaccccctcgacatccctcgtgtagtgagggatggggccactcactgacggtgactcagggccccagaatgcatgtgatttacccagaagcgggcaaggagggaagctggggtttggggtgccggggatgaacaggaacaaaggagaggcgctgtggctccccgttctggaccctcgtctggccacagggaagcagcactgatgactctggggaaaggccccggcctctgaatcagataaacctcaagtcgctgctctgctgttttactggctgtgtgacctgggcaagtctttctatccctcggagcctctgtgttcttatctgtaaaatgggagtaatcctagcctcacgggctggctgtcaggattaaaagtgctttctaatcctggcattggcagctatttgagccattggtggctttgcaggtctgacccgactctctgggccatggggtggtgctcgggcctaggtggggacccctgtggagtcagactgtctgctctgagccccagggccctgaagcttgggtggcagccctgcagttgcccagagttcctgtctaagtggctttgttgcccatcatctcagaaagcaacttctttcctccctgccttttcctgtctgtgcttctgccccagtgccccctggctgggctctcaaacccactgcttgacagcctggtcttaggacactgtattgtggcaaaggctgtggggtcaggatatcccctcccctccctttgccaccccttttagtgagtaacaggtgctgtgtgttttggggatgagtgaagggtacatttggtgaagcacagagagagtgcacaaggcttcagtttgcaagatgggcacgggaagattccaggccatctccaaaacctcttccatctccaacctctgtgctgctgaaggttctgtttacttgtgaccctgagaaggggatgccctatgggggctcttctgagatcatgctgtccattttcctgcctccaagtgacttctaagacagcatggctctgaggaaggagcactgacttgggtgttgggagatcacagttcccatctgagcaccgtcactggcttgctgtgctaccttgcttgggttacttaacctctctgggcctaagcatccctatctatgaaacctaacaaccctggttccaatgctttcctagaatattggggaagtgtcggctttgagtatacttgacaaaggccacagattgggggtggggtatataaaagtctacaggaaggagagcccaggactccccactgtcaatatcttggttccccagcttctcttcttcttgctgacctcaatctcacttgctttgggtggattgatttcctgactcaggctccagggccatcaagaattcacggctgcctttcagccttcatgaaggacatggtggagctccttaggcagaactggggtttgtggatgtcctgcctctctgccccttggtacctaggtggcaccttttcaagttcgggagctagatcctttccccttccccacactgtaggaaagtccttactgtaggcaggcgctgcagagcctgctgtctgggaacccacaggttcaaggaagccttgagcaggaagggcgttttcctggaagaagccctttgtcgctggtaatgggtgcaggctgctctgacccggttctgagtcctgcccccttccaggcctagggctttgggccttgatcacctctgctgagtagctgactgcggggctggggctctgatgctcaggacccacctctctgggacccacagtctttttccactgtggcgtgtagtgatgtcacaggtggcagtgatgtcactgtggtttgaggtacttggctgtgagccccggaggaggaagtgtctgttcgctgatggggggttggaagagatcattgacttctgccccaagcgtgagccccaagtgtgcaggggggagtgcggggggagggctgttggcggcgcatcccagggctctggctctgcccttgcatctagcctgtctttcctgtgggctgtgacaagccactctgcatctctgagactccatttcttcttcttcttcttcttcttcttcttcttcttcttcttctccttctccttctccttctccttctccttctccttctccttctccttctccttctccttctccttctccttctccttctccttctccttctccttcttcttctgatggagtctgactccgttgcccaggctggagtgcagtggcgtgatcttggctcactgcaacctctgcctcccaggttcaagctattctccagcctcaaccttccaagtaactgggattacaggcatgcaccaccacacccggctagtttttgtatttttagtagagatggggtttcaccatgttggccaggctggtctcgaactcctgacctcaagtgatctgcccgccttggcctcccaaagtgctggaattacaggcgtgagccactgcgcccagcttccatttcttctttgaaaagtaggaggggttggaattgtcaccctggaggttcatggttgctagattattgattctgttgctggattcaggagacctgttagctggctagttcacagcaagtattgggtgtttggaggggggctgcagagccccttctcaggccccaggagggccagctgccctccctaccccctcttttggacactagtgggcatgttctgctgggaaaacagacagtgtaacctgacttcgagggctgcaggctgaatctctttcagatgtactggctccttgagaggcctagcagatctctactctgtgggtccctttcggagctggggctcaggtttgacccagccactctgaccggagacagcgcagaaatcaccaggagcatttgtttgttttcctttgctgtccagacagtggcccaccgtctgcttcagtctgagcgtggccctgcactagtgagactgatgtggccacaggttcagagaatcagtgcgcctgagtgggagagcagagcgggaggggatttggaggcaggcgggctgtggacagggaggggggaggacatcttccgagctgtcagcgggaggccttcttgaaggtctttcaggagcaaggccagaggccgtgggagtgggcggggcctggggctgggagtcaggggtctgaggcctcatcttggcccggcctctgcttccgggagaacttggccaattcccttctcctttctgaaccttggtggccccagctgtcacttgagattagcaaggacctccctggtcccagcaggagtgagtggctttgggcagggggtggagtgcagattgcactgccacgtcacccagctcagaaggcccaggtgtggtccagctgtggacttgattgtgaactcctggggaagggctctggtcctttgcctcagttagcgggacccccaccagtgccctgggtgcccctgctggcccctcctctcgctgaccccagccccagtttctggctgcaactcacagaggccccaggctcctgtggccccatcaccagcagctcctgctgtcatttcctgagcctcgcaagcccctaatcctgctccttcctgtcctggcccccagctccctcaagccccactcctgcatcccattctccctggacatcacccctcccaccccttggctcaatttccttcctgtcgtggcttggtcctttggtcattgccctggtcttttcttgtccccttcctgattctgcccttctccaggcccacacggggaacctcctaaccgctgagccctgaaaggtaggcgggtttaggatgagtggctacagggaggagaatggtgtggggagagagatatggaggaaagaatattaggggacaggccgggcacggtggctcacgcctgtaatcccagcactttgggaggccaaggcgggcggatcacttgaggtcaggagttggagaccaccctggccaacatggtgaaaccctgtctctactgaaaaaaaaaaaaaaaattagccaggcgtggtggtgtgcacctgtagtcccagctacttgggaggctgaggtatgagaatcacttgaaccccagaggcggaggttgccgtgagctgagatcgcaccattgcactccagtctgggtgacagaacgagaccctgtctcaaaaaagcaaaacaaaacaaaacaaaaaccgaatattagaggacaatgttaggactgtcccagctgtcctagctggagccaaaggtttgttggggacagtgacagcagcacacgaggctgtaagtttagggccagtttatggaggagtagtaccaattacattgagaaaactgtagcaactataatttgggaggaattttctaaatactttacatgtgttatttaatcttcccatcagccccaggaggtatgtgcatttatcagtcccattctacagatgaaaagactgaggtctatgaactcctttatttaaaaacaaaacaaaaccccctcaaggctgcctgctaagaggggaggagtgtggattcaagccagcatccttattccagtgtccatgctctcagccaccacacacacactcctatcaggagttggggcagtggggagccattatagtttttgagcaagagagtgacagggcaaagatcactgtggcctcagtgtgaagcacagatgagatggagagactggaggcagggaggcccatgaggaggctgtcaacatggttcaggtgacagctctgggttggtgaagaagcagagaacaggaaggaaggggcgagaggcttgagggaggaggaggaagcctttggactgggccgtggatatagggtgggaacataggaggtgaggagcatgctctctccacctgctttttgcaacatgcggcctctctggccttagctctgcctgtcctgagccctgagccctgagcccaatggaccgattctgttttttttttgagatggagtcttgctcttgttgcctaggctggagtgcagtggtgtgatcttggctcactgcaacctctgccttctgagttcaagcgattctcccacctcagcctcccaagtagctgggactacaggcgtgccccaccacgcctggctaattttttgtattttttttagtagagatggtgtttcgccatgttggcccggctggtcttgaactcctgacctcaggtgatccacctgccttggcctcccagagtgctgggattacaggcgggagccaccgtgcccggccccagtggactgattctggtcagtgtcaaccccatttgtccctggagcttttgcagtcggtcacagggccagcccggtcctggtcaccgctggctggttaccccggctgggttgggcaggagtctgggcagggctggttgctcatctcaggtatgaaattggctgcacccccactagtgtgggggagcaggattccagggcctgcctggcgctgctacccctgtgcctccagacccctcgagctcctcccagacctttggcttcgttgactgtgaggtgaaaacaaaagggctgctctctgtcacttcccctaggggcgggcagatgctggcagggcacagagagccgagggctaagagctgacatttagcctggctactcaggagactgaggcaggagaatcgcttgaacctgggaggcggagtttgcagtgaaccgagatcgcgccattgcactccagcctgggtgacagggtgagattctgtctccaaaaaaaaaaaaaaaagaagagctgacatttagcgggtgcttcttgggtgcaatgcgcaagagaccgatgcattaactacacagagtgcccttccttgtcacagctacctgggggcaggggaacatcatccccattttacagaagaggcctttgaagcacagagattaactgacgtacttagggttttgcagctcactagaggcagagccaagactccaccccaggtggccaggctcctgagcgctatgcctacctcaccctccaatgaggtggtggtggaggagaccgtgagccgctgtcacctgaacactggtgcactcagtctgctgctctgaggacgccgccccctctctttgtaagtccatttcctgcccatttctcatgctagctccagctcatttcaactaattgaaaattaaaactttgcttctgttgagcaattcggcatcgatgagacgccagctgtgggctgtgtgctggctgtgtgtagggtgatgagtagcagaagcacgggtgacactgagctctttccactgccgggcacggtgccaagcacgccacgtatactgacttcatgaatcataaagccctgtgaagggggcactgtttctgtcgccattttatagatgataaagtggaggtgggggaatggcagaactgggatcaaagcccacgtgtctgtgtctggctcagcgcccatacaagggtgtcaaggttgcggggaggcacgagggaaccaataattaaccaaaactggtcgggtgtgggcagtatagagatgcacccgggttgtcacaggagcccctaggagggacctctgacctccctgaaatgatggcagagggaactcttgaaagaagctgagaagtcagcactgccaggtcgggggtggcgggtcaggacgtttgggcagaggcagcagcagtacgggcatggagaagggggcggaggagccaggtgctgctttgtgttgtgacagcaacaggtgagtgatgaatacaggtgggagatgctggcaggggctaaggaggttgcgcaggtggtggcagccgctggaagcttttaaggagagtcaggcttgattgtaggaagggggcttaggtccatctgaaagggacagaaggctgggaaccaagaccaaggagcctgcagctggcaggagatgctgagggcagcgaggaggaggggtcgtgggagatggagcaggcgacatcagcaggccccttggagggtgacggtgggagaggctggggcgtctctcattagactcagggttccttgcaggcagggaccatgcccggcgtctttgtaccctggcatttagcacaaagcctggctccaagaaccggataccagcccagtcttcctgtctgcccccagctcatttctaaagcaacatcacaggcagcgagtcgggagtgggatgtgtcacccccgggttgcctgcctgtgatgtggtcagtccttcctaacgcagatgccattcctctccgtgacggcagacgggcctccgctgtcactggccctggcgttgctgtgacgacctggcctgatgtagctgcaccctgcagtccatggggctcctgtgaacccccaaggttgagacccaaatgcctctgctgcctcccaccacgccctaggggccccgcgacccgccatgcaaatgacgtggtttccgcattgcttgaagagggtttcctctgtgtgggggtccctgggtccttgggcagatacctctgcccctccccacagctttggcccctgccctaagaccctggagacccttttgcctgggagagtcactgaaccacctgcccctgctcacagtgtgttcacagaagagtcactcccctctgtgggctccttgtctgtaaaatgagggagcaggacaagatcacagggtacaaaactgtcagagggcacagaggctgatgttgctgccatcagctcctggagtgccgctcactggctgcatgaccttggacaatttgcacgaaatctcccaagcctcaatgtctgcatctgtaaaatggatcatcctgacctcattgcgttagtgctaggataaaataaagagaaggtatatgaacgtgcccagcactgtgcctgcacacagtaggtacttttcctggatctgaacagtctctgttcttccagctctgtgtaaaggcttgatctcgacccctaaagcctgaagcttctccctgtggccacctccccaccgcatcatcttccgttctcagcgggtagatccctgcccaggggggaccccctggggaaggctgggagcatgacctcttcccaagggtacggcatctaaaagggatctccggaacattgaaaagccatgaaggccgggcacagcggctcacgcctgtaatcccagcactttgggaggctgagggaggaggatcgcttaaggccaggagttcaagaccagtctggacaacatagcaagacccggtctctttctataaatgaaaaaataataataaagccatgaagatccccaaagaaggctgtgctaatggcggccggaagagcagagggcaccacagatgccgtgctttcagctttttccttctcctccaggcctcccttctttccttcctctctcgctatttataaataagagaaggcattgagggcccccacctcgggtacttgcagggccttggcctgggaacaggacaagcagcaagtcagttgacccggggttgctcaattccccaagagctgacgcaaactccagaatcagacctgccctggccacctggccctgccccttaccagctaagggctccagcagagtcctagtcttgagcgaatcttatacctgcagccctgtccaccagctgtgcttcctgagtcctccagggtgagggggcgtggggtcagaagagaggggacggtgtgcagggagggtggaacctgactgaccgggtcagccttactcttccagcggggtcttttcttcctggagctcggccctcggcagctctcagaagctcaccttcttgcaggctctcacagccgcatcgtcctctggctgggctgctcacagaccccggcccctgggttttgtccactcacccagactctgttttggggtcacattacccttccagtgttcctctgagcaaagtccctgtgagttagcccaaggtccctgtcaaggaggaccacatctggcctgttgcactcttctcctttgccccaccgaagcctctgtcacactgtcacagcagcgggcctgccatggtctccccatgtaaggcttcctgaggaacgggcctggtgccagcctgggggtgaactgccagccccaggagtcacaggtcagcttccccacacttaccctggaggcaggatggaggccccctcctttgcaaggcccacacgggccatctaacaccccactaaagccgggcagttcgctgccctggggtgtgttctcgccttgccagttcttggctaaaaccaaggcaggaagagcccagttcccatgttctgtaacatgggtctatgaccagggcctttgcaggccccttgcagcgcccccatggagcccccaggagtctgggagaagatgatgaacccaagtgaggacctccccaggggcctttgctcctcacaagaacccctggaggagacagggcaaggagtaccactcccattttacaggtgacaatgccgaggctcagagaaagtccatgacacccccaaatcccccggacccactaccctgacctcctggcggtgcacagagcatgccacgcacctctccatatgcacatagaccctctaacctaagtcagcgccccttctacaaggccggtgtccagcacacctgggaaaggggacatttctggccctttcctctcagaagtcgcctgctcgagctgccctccctggggggaaggggatgggggcagaagctgagcatggaagcccctgctaatccaccctctgctctctccagaggcccaggaccagcccaactctgccccacatcccagcccccacctcccagctcgtgctgtttctccacctctcatgtggatgggccacacaccacccagcacccctgaggtctggtgagggactgagccttcgacacccatccttaagaacccagggctggtccttttgcttagagcatcaaccaggcccacactctcattttacaggcagagaaactgaggcacagagaacctggttactgcccacagcagaggagacacttgagtgaggacacagaggatctttggggtaggggcgggccttggggttgagacccagtcttcctggccagggaggaaacacaggactggaggtgaggaggcctctttgaggctagtttcttcatctgtaacttgggaataacaataggactggcctcagggggaccaggggaggattcagagaggctatgatgctgggacagctcttcgtgatgactggcatgaagcaggcttctagtagatgctctactgctgctttcgttctcaccctcacccacccgctctgggcccactgccctgacctcctgaccaagcactgagtgtgccaagggcatctccctgtctccccggccccgcaccttgtgtcacccttttccttagctcttaccaccaccttgaattctctattgaacgtgcatgtgtctccccagctaagatgacaacttcccgggggcagggatttgatttgttcaatgctactgtttacccagcacctacaacactgggtgctcagcacgtctgttgaatgaatgaatgaatgaatcactgctttcacctttgcccctgactttctccatggaccacggacaagtgacttgatctccctgagctgtgaaatggggccattcacaccagctttttagggtggaactaggattttatacagtgcctgccatctggcctggcacatagtagttgcttagcaaatatcccattgttttccttcctccccagagggccaaagccaagacctggaggagcaacagggtgggggtctaacccctgggtgacagagacagctcccatctgggatggaggctgcatggtgggaggagctgctgaggttgggccattcagctttggggcccttggagtcctgggtctgtgtggagggggaagggaagctctctgggccccaagagaagggaggcaggattgggggtggcaaggattgcagctcttctgggatagccttgggcacactgctttgtctccctgagcacctgcgaatgtcagtgagaagaccagacagtgggtctaacacgcacagttgcccctgggaggtagcaggtgctcggtaccgatgagctaccgctaactgcaggtgctacctgtcttagaggagggagcccaatctggaggaggggaaatgggagctgtggacccagatgggaggcggctcagagactgtgggtgggccctgatgagcttcttatccatagtcctctatccgcttgccgccatcctggccctggcatggcccaaagtctctgggagacgaggggaggtggctttgcctttttccatctctgttatctcatctgtgaaatgggcacaatcagacctgcctcaccaattggaatatagatttaggtgcagttttcttttttctttccttttatctattctctctctctctctctctctctctctatgtatatatgtatagctatctattgatattttctatcatccatctatttatcttgtatctactttctattatctctatcatctatttatctaatctatcatctatctagctatctttctattttatctatctatctatctgtttgtctgtctgttttatctatctagctattttatctattttatctatctatctatctatctatctatctatctatctatctatctatctatctattctatctacctatctatctatctatctatctatctatctagctagctagctagctagctatctattctatctacctacctatctatctatctagctatctatctattctatctacctatctatctatctatctatctatctacctacctacctacctacatatctatccatcctctccgattccctcaccactgggtctcagattccctgcctgttaaataaatggtcagttaaccctcaacagtgattttcaatttttcacttgaggcccccatattttggaagattgtagtttgctgaacacgctgactgaatcaagtactatccaacttatttcctcattttaacatgtcaaagatcccctgtggggtgagtggggtgtgaattggagcctccccaatccaaggcacaggaactggaagcttctgtagccctgcatttcctagagaatgcttgccatgttttggggacctcctggggggcccctgtactgaccagaggccggctcccagggctgtggtttgggcccagccccctgctcctggggactgctgctgtggagggagtgaccttttgttctgctttgccaaggggctttctgttcctcattgtttagccatgacaaggctgtggatttttttttttttttctgtccaagagaataaacaggcctgagattgctcaagggagccgaccccctctgccagctactgggggctggaggctcacagagccagggaggaagtcctaccccctctgccggctaccgggggggctggagccacacagagccagggaggaagtccagggacggtcactcacagcaaagcctcagacaagagaggaacctggaggggaggaggtgggaggccaccactcagccggcctgggggccatgggagtccagctgcctgccgttagtggccaggagccctcgtccattgcggctcttgagagcccaaacttggccacggcagggctctttcccatcaggccctttgagccctgatgggaaacccttccccagccagggtgggatttcttgctgccgcctggagccgccctggccctgtggttctcaggccctggaggagtgaggggctcccctggttaccccaagggcactcgtggggatgaagcccgcgggatgcaggattcccacgagacctgtgctggccactgtgcggggtggggggctgccagggaagaggtgcagcccctgcctgcctcagggatgcgatctgagggaagaggcagctgtgtctgggaggccgttcggtcggagggggataggcacagcccctgcccttggggaagcgcccagcagcagccttcagggaaggcagtttgggggtttgccgagggccaggaagaccctctgccgcagttagtattcgatggaatggcttgtgcagagggagctgcagaagctgccatttctctgggttaggggctcccacagcctttggatgccgggtctcggccatgagccccctccgccacccctcccccaggtcaccttgctcaatccaggaggccggatgatcagagtgtgttctgcaaaggagcgtgagaatcactggggagatttcctttttctttttctttctctttttttaatggtacagcttcctgggcccacccctgagattctgcacttgtttggggagtgggtgttggcttcatgacaggcacccctgggtgctttggacacaggcagtgagctccccccacactgtgtgaacccctgagaaggcttctccttttgtctagggtgcctgggagtctgctccagcagcaaaccggggaggggaggggtactgggaccgagtgtgtgtggcagcaccgtgtccaggcaaactgaggctccagacgggggttacttcttcagaccctgttatgcagcatggttcccactgcccgtgcccagaattcaccatagctgatgggcctggggtgggcctccggggcaggccagggtggaaagtgcatctgtgtttgagctttgcggccctggcgctggagttagatccctacaggaaaggacattgtaacccagcccgtggttgagactagcagctgctgagcacctacgccctgctaggctgtggggcaacagcaaagggtaacccccagcctgcagcctcaggggggcttcccatctagcgaggggcccagggaggccatgaggagagccatgagggaggaaggtggggactctgggcctgagtgactccttcagggtggggtgcgggcagggagccttcaggagggagggtactgcctgagcagggctcttaagggacacgtggaatttgttacaggaagcaccaggccattccaggcatagaaatcagctggggtgcaaaggcctgggggtcagaagagtggcagattgctccatggcaggaagccccagctcctctgggtcgttcccgctgagggattccagctgttggcaccgaggggtgcagccagggcagggtggtgctgcctgccaggctgaggtgggagacagctgggtttctagccctgcttgtcactcgctataggtgcagccaaacgctcagcaggcccaaactctgggcagtcctgactcccaggcagtgctgtgaggaaggggaggaggaggcacactgaacccacctgctacgttggctggtggaaatttggccaggtctgcactggcccagcggtgctgggtgtcgtgactggtgtctgctctgactggcttgctgacagctgaagtccaggataggtccatggccacgttgtgctggtttgttaaatatttttagtatctcccctgctcctatatgttaggtactggagtccagagaggttaaggcacttgcctaaggccacacagccgctaagtggtggagtgaggatttgaaaccagttctttctgactccctgtatccttatctatggagaggccccatgactcgttcactaaaggttatggatctcgatcttgtactggccacatgactgcagctggcagtacagtggggagtgcgccagccctggctctgacctcctagaactgccctttgttcatttccaggtgacgcatctgtgggggcccctgaaggacttggggtgtgtgtgtacaccctctttgcttgtacagatgtgttcacacccatgtttgcctacatgtgaatgtctccattctgagcttgctctcagcctggtagaggtggctaattaatgcttgtccctgaaagcccggactgccaaccccagtctttcaggagagagggcaggactcaggggcttgctcccgggggtcctgggaaggcacaatggtgacagtgctgcagctctgcactcctggagggtcactcagagacccgagagaggagggctctgcgtctgctcctctgtccagggctgtagcttctctgggtgcctttgcttttctcttttctcccctctttttttttttttttcgagatggagttttgctctgtcaattaggctggaagtgcagtggcatgatctcagctcactgcaacctcctcctcccaggttcaggggattctcctgcctcagcctccagagtagctgggattacaggcacacgccactatgccgggataattttgtatttttagtagagacagggttttgccttgttggccaggctggtctcgaactcttgacctcaagtgatccacctgcttcggcctcccaaagtgctgggattacaggtgtgagccaccacacctggccctctctctcttttcattcatcacattgttcatctcttcccggaggcatccagcacagtctttgagactgtgagctgtgaagtcagacaggacccaggtccaaacccttctctgtcacttaccaggtctgggaccttgggcaggtgacctgccctctcaggcctcggtttcctgttctataaaatggctgcagtagggaaaccgtctccatcttcattgggtggttgggaagtcttgctgagaccacacacctgtctcaggtagggtcttccagaagcagagcctgaggcagggatctttgtgaaagtgatttgctagggagggctcccaggagaagcaggcagggcaggtcaggggagggggcttagcagggacgttgttcaccagcttcagcccaacaccacgggggtggctctggaccatgaattgtaccagggtgggtcccaccttgaggctgtggagcattcattatcagccaacacccacagcagctgggggagcggtgccctgctggcagcaggggtctgagtggggtgcaacagcacccaccaattcgagcagcagaaacgcttagaacagtgcctggtacctaggcagtgcttcaaaaatggcaacgattgtcatggtcataaccaacattcagctgatgagtgccggctctacggtgggtcccatgtgagagattgagggtctagagatgacaaggctgccacctctgctgtctgcatcacatgagtgtgtgtgtacacatgtgtgtgcatacatacccacagggggtggaaggacaagcaagtaaccattccagaacaatgagatgactgttagaggggtcataacccacgtttagagagagccgagaggaggaggaggaggagcttgaattagccttgggtagtcagggagggcttcccagaggtggcagcactcatcttgaaagacaaagggatgtttcaggtgcaggagggaaggagaggtatcttccttcctcagcagagggcagctttgtgctgagaacccccgttctctgtgaccaaggccactgtcttctggatatctgtcccatgcagtgttaggggtcacccagcactggagaaggccagcagagtcagtgcttctgcctgcagacatgactagggtacactgaggtggggaggcaggggaggtaaaagaaggcacgagctctccttcctgtaccctgctccagggggagaaacctccccagccatcatcagtgcagactggcagggggagggccaaacatttgcagggcggggacctgggcatcaggcatggcagaacccaggggcggccctgttgatggcagtcttcccttcttccttccaggtggcatttacaccctacgccccggagcccgggagcacatgccggctcagagaatactatgaccagacagctcagatgtgctgcagcaaatgctcgccgggtgagggcagccacgggggcactcggggcccatgccctggaggagcgtgtgtgtacaggggctggggcgcaagagcatagcccttgattcttactgaactcctagttctatgcactggcccatgctccctgctgcttctgggcctgtgaacatgctgttccctcttcctggcacacttcccaactccctttccctgattaactccaacttgccctttagacctcagctgaagatgtcccctcttccaggaaggctgcctgccccatactgcccagccggtggaggagggggaggaggagcctaaattagctcctgggggagtcagggagggctgcctggaggaggcagcactcagcttgaaagacaagtgctgcctcctttgagctctcactggcctctgatgttcccatggaagctctttccttgctgtgggattatagcccggtcctgcttcctgttgcctccactgtgtgctcctctagggcagagattgtggcttgttttctgctgaatccccagcacgtggcgcaatgccatgtaggtgctcagtgcatatttgactgactctgtgaatgcttacccatttcacagatggtagacctgaggcccagccacagttggtggagctaggtagcctgactcctggtgccctccatctattcatttgtgtctgtattcattcatgtcatgattataaggtatctgctgtgtgttctaagtgctgggaatacacagagagcagggcagacaaaacccttgccctcgtggagtctgcattttaacggtggatgcagacagatacattaggagatgtgtggtcctgtctatctgtaagtgctgtagaaagacaaggtcaggtaaggcgggggagacagaacgggacatactgttttacacagggtggtctgggaaggtctctctgaggaggtgacatttgggcagagccctgcaggaggtgagggagcaggtcatgcatgtatacagggaacagtgtgccaggaggaagcaacagcatgtgcgaaggccttgaagtcggagcctgtttggtgagttggaggaacagcagggccagcatgtgtggcccaggatgagcgaaggcgagtacggtaggggaggaggaggaaggagtgagcagggaccatggtaaggagtttagattttattctgtctgggagccaatggagggctttgagccgttaccttgagatgtaggtgggcatatgagtacctgtcaccgtccctagccattttaagacatcctagggaaagtgactctcttctttcttttattaactggaagggtctctttaagaagttactagagaggctgaggtgggcggaccaccggaggccaggagtttgagaccagcctggccaacatggtggaacccgtctctactaagaatacaaaaaaatagctgggcataatggcaggcacctgtaatcccagctacttgggaggctgaggcaggagaattgcttgagcctgagaggcagaggttgcagtgagccgagattgtgccactgcactctagcctgggccacagagtgagattctgtctcaaaaaaaaaaaaaaaaaaaaaagcagctactgagtcaacttttttttaaggtttccgttggtgttctctgtccctggaatgcctgctttccaggcccatgcccttgtccttgataggataccagggactacattcttactacctgttccccctatcattcatgcccctagctggagaatattagccatctatcaagaaggaagaaactggcaagctagttcttactaaagtgtgattgactgataatagggctccagtggtggaggttcaagcatctggaaagagcagagaggaatctatttttgagcagaaggggttcagaaatgacgtgatagctggtacaatactagatgggagatgattctgaggaattggaactccacagaatagccttcccagctgggctttagaactctggactttgtggggacagtggatgagcccagggtcctggcagaaggctcgcccagctgagacctctggcccttgtttcctcaggccaacatgcaaaagtcttctgtaccaagacctcggacaccgtgtgtgactcctgtgaggacagcacatacacccagctctggaactgggttcccgagtgcttgagctgtggctcccgctgtagctctggtgagtaggttcagagaaaaagggggcccttacacccctgcctccaacttcccccggcaactccagcctctttggcttccagctgtctggagttaccccaggctggttgttggaagtggcacaggtgcagctgtttacccctaccactggcattttcctcctctgtctcaccaaagcctcttcacagccccacggggcaggcggtgggagaactgtgcccacgtgagggttgaggaggtggtgcgtgggagagtggtgcgcatgctcgtgctgcgaggagcaggactgcggggaggagcgaaactgctgggaagagcgggactgcggggaagagcgggacttcggggaggagcggcactgcggggaggagcaggactgcagggaggagcgggactgtggggaggagcgggacttcggggaggagcgggactgcgggggacgagcgcgactgcgggggacgagcaggactgcggagagtagcgggactgcggagagtagcgggactgcggagagtagcaggactgccggtcctgcccctggactctggccggtgttgtgtgtgccccatgctgaggcggtccgccagcctcctggagatccgctgtctgagagtgctgggctgtctgggagggcagcgtgggtgtggcggaggcaggcgtgaccgtttgccgccctctcgctgctctagaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggtacggggtggggctcaggtccttggggacgcccatgggcctctcctttgtagacatccttgcagtgtcacgggcatcaacccattaattagtccagcagggagcactgttagtggtggccaggtgcctgctacccatccgtctgtccacctgtccaccgttcattcttcctgccagcactcccgattaggcacctcttatgtactggaaccaggagacccagagatggatcagaccaagccctaagctaggaaagttatgtgatgctgcaagatgaactcacataactctacagcccaatcccgtgcatgtgtgtacaggaatctgtgtgtgtgcatgtgtgtacaggcatctgtgtgtgtgtgtgtgtgtgtgtgtgtgtgtaaggggtggaggtgcagacagagctccttgggcccctcagacctctcctagggctctagtgccaaggcccagctgtcccgcagagtgtctgagtggttgacaagttcggattgttccctgaaggaactgaaacatcagacgtggtgtgcaagccctgtgccccggggacgttctccaacacgacttcatccacggatatttgcaggccccaccagatgtgagtagctgagtcctttggttctggaggagcagggaggggctgtccctgggtgactgtgggtccaggacacagagcagctcaccaaccaccattgtccagactgctttatctgagggtggctcccaggataaatggcatggtgggcaggaccttgccctggaaggcaggactgggtgggtgcatggggaggtgggggagggctaggagggggtggtcctcagagagggcacacatcgtcactctcctatcctgcctgctggggcccgtgaatgagcccagccaccccagccactctgtcccctgctgcctcctgaccaagcctcctcctcctccagctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacttcgctcttccagttggtaagtcgcaagaagtctcattcattcactccttctgtctgcctgtctttctgtctctctttcttcctctcccatggttttactgagagcccacggggggctggaccctgtgccctgtcctgggatacaggtggcagtgagactgctttctccccacacctggtgctatcattcaaaatccctaagtgcgtgggctggatgcagtggctcaagcctgtaatcccagtgctttgggaggccaaggaggctggaggattgcttgaggctaagagtttgaggtcagtctgggtaacacagcgagactccatctctataaaaaaattaaaaaattatttgggtgggatggtgcctattgtcccagctactcaggaggctgaggtgggaggatcacatgagcccaggaatttgaggctgcattgagctctgatcgtgccactgcactccagcctgggcaatgagtgaggtcctatctcaaaaacaaaacaaaaccaaacaaaacccctggataggggagaggtggggtcagcaattcacctgaatatgcagatggtctccttgctgctgtttctgatgagcccattaggctaagaagacagcgggctgggccaggtcacctccaggggcttccattctggggtagaactgcatcaggccagaggtctcaaactagtggcccttaggctgaatgaggcacacagacatgattgctttgtaattggatttgagaatctccggcctagactcgcccctcatttgcaatgacccgaagcaccttgggtccctggcttgcctggctggcccctggtacatttgagtttgttttctgtagctgtctgagcttctcttttctttctaggactgattgtgggtgtgacagccttgggtctactaataataggagtggtgaactgtgtcatcatgacccaggtgaaaagtaagagtccatccttccttccttcatccacttgttcaggaagcttttgtggggtgcctcctgtgagtccagcactgggcacagccttaggggtcagacagagctggatatgggggtccttgttctgtaggagcttaaggcctggggtgaaggtacctctgctaacttaattactaaaaggcaagaggtgatcagggttttctaaagggtaggaggagttcaggattcctatccaggaagcctgggggattcgggcttcctgcagcaggtggtctctgagctgggtaagatcttgatgggtggagtctgtgcagggaaggacacgcatcctcagtggaggcgcggatggtatagatgggggactggagaatggttgggatggtggcaggtggagttgggtgggggcttctgtggaccttgtctggtaggcgattggtccccacagggctgggcctctctgctggttctatggggccccatactgccctcctacttaggacagatgtgcctgaggaagtcaatctcttacttgtcccctctcctctttatagagaagcccttgtgcctgcagagagaagccaaggtggtgagtgtctccactgccctctccccctcttcccctggtctccttcccggcgtgctgggctgtcacagaggaagcagtgaattctgtcattggtctgtccagtgtcaggaggtgtgcagagccctgggaggtggaggaaaggccggggagtcaggcagccctccatgggctaagagaggctgtgagtgtgaaatgctccggcagagagcagatgccttcgtggcgttcgtggcaggcacgtggtcgtggacccacagcgcaaccttgggcagatgtgaaattgctctatggctacttccttaccatgagatgggggttgtgtctgctcgatccagcctgcagggtggtgccattcggtcagctgacaatgatgtttctccttgcctccattgtgtttacagagcactttctcagagagcagtggttttcaaactgaattctgggatagcccagtgtcccacagagggcccttgggcgtgggggaagtggtcatctctcaggtttgaggtagaggctgtggggctgggccctgggtcctcccaaagcaactcacctttgatctgttttataaagtagggcctgcgaaggctttttgttagagacagaccaacagtgtgtcatatcatagtatttcattcattctccatcaggaaggcatttggctgcaagtaaccccaaacctacaggtgactttagaaaaaatggctttatttttcttgcattgtaagaagtcaaggggttggtgtctgctggaatggcctccactatccccttgcatggtgccagcaggaccccaggctctgtcatctttagtgtgttgacttttgttctcttgtttgtggcctcatgtcataagatggtaatcatcacttcatatgtcacctctaagtttgaggtgggaagaaggggcaggtggccaggtcagccatggtgcccttatcagtaaatcggatgccttcccagaagccctgggtagacttctttcatctcactgaccagacagtgtcacatgaccacccctagctgcgagggaagctgggaaagagggtgttttgcttttccagcctctatggaggaggaggacaagggaggggggttggaagtgggtatggggtgagccagaacatacgtctgtcacagccttgcacctggtaggcagggcaggttttttacccaatttgacagatgagaaaacagagtctgatgagttttctcgacctcaggggcaggtagagaaagaacttctcaacctcatggatatttgagacaacatcttacttaagggaggccaaggtgggaggattgcttgagtctaggagttcaagaccagcctgggaaacacagtgagaccctatccctaaacaaaattaaataaaataaatatttttaaaaaggatcttggctgggcacggtggctcactcctgtaatcccagcactttggaaggccgaggtagatggatcacttgaggtcaggagttcaagactagtctggccatcatggtaaaaccccatctctactaaaaacagaaaaattagccaggcgtggtggcacgtgcctgtagtctcagctactcgggaggctgaggcaggagagtcgcttgaacccgggcagtggaggttgcaatgagctgagatcacaccactgctctccagcctgggcaatagagcaagactccatctcaaaagaaaaaataaaataaaataaataaataaaatatcttacttagttgtgggggctgtcccgtgctattcagcagcatctttggtctttatttacttacatgccagcctcattcccactccagtggtgacaatcaaaaattctccagacatcaccaagtgtcccctggagggcaaaatcacccctagtggagaaccactgctcgagggaacagctcagccctgggcagcccaatacccgaagcttacaccaggtgtttggaatcagatagattgatttcatcccctgattttggtgacaagaaaagagatgcagggaggaaaactgagttgctcaaggtcgcaccgcagtgtgtctctggactcccatctcagtgctctttgccctgccctacagtatttcagtggggaggaaattttctcattccccggcgagcgagtttcactgctccctttctccagcttcaattcagtgacactgacggttgccgcctggtggcgtgcgtagagcaggtgtctcccccaagctcttccgcagcagcccagctgtcaccttccctttccccaccaagcgtttcccaatcctctgtgcactgaagatgtcctgggtgtggcctagcagcctctgcttcccttttccattttttttttctttctttctttttttttttttgagacagctatgtcgcccaggctgcagtgcagtggcgccctcttggctcactgcagcctccgcctcccgggttcgagtggtcatcccacctcagcctcccaagtagatgggactatgggcatgcgccaccatgcctggctaatttttatatttttagtagagacggggttttgccatgttggccaggctggtctcaaacccctgacctcaagtgatctgcccacctcggtctcccaaagtactgggatgagaggcataagccaccacgcctggcccctttcctttcactgttgctctcagtgttcactgaatgtgagtgactcaagtatctgttgagtgccccagtggtgtgtctagtgcagaaaaaaacccccaaaccctgatttgtggtgtttgctaatttctgtggtataaacactcacactgtagccagtttccaactcccaagaccttcctgaatatggagttgggaggaaatctgcacaggcctgagcttatcccagcacagccctggctgagccctgccaggctctttgtgactgagtccccacgcatccctgtggggcagggagcatcatcacccccattttacagaggaggaaactgagactctgggaggttccatttttcctgtaggattagatcattaggtgagtggcatagcccaggtttgaatcaggtttatgcctgtgtcccacgctactcctcaaccagcagctactcctgataagaggccagtggagagtcctcttgagctgggctgctgggcttagagtgtggactcagcacccacctgctcctcctgccacagaaagaacgtccagggcatgggagacagtggcgttcctttgtttagaaaacaccaacatgtggccgggcgccatggctcacgcctgtaatcccagcactttgggaggccgaggggggcggatcacgaggtcaggagatcgagaccatcctggctaacacagtgaaaccccatctctactaaaaataaaaaaaattagccgggcgtggtggcgggcgcccgtagtcccagctactccggaggctgaggcagaatagcgtgaacccgggaggtggagcttgcagtgtactgagatcgcaccactgcactccagcctgggcgatagagcgagactccatctcaaaaaaaaaaaaaaaaaaaaccaatatgtgagcttacccacaatcacccccatggacacggacacactcatgcacggacccacgtctgataacaggtgcgaacatttatcgggtgttgaacggatgccaggcactgtgcccagcgttctttattctcacagccatgctgccacacgcaggcagtatgattcttgtcccccattatatggcccaagaatcatgggcccagagaagttagtaactttcccagtgtggcacagctaatgatcacggcctgggacacgaacctaggagtgtctctcctcgccaccccagcgcacacactcactacgtcactcacagatatgcacacatgcccccaacatagacacacgtgtgcacgcttcacaccctcacgcctgtagacacaggtgtgtgagccttgtgaacacacaaacagacggacacagcaggaacctggaggacctggcccgtggctctgctgggtctctgcttctgcccagcagggctgggccaggaggggccgggagctgagggtgctggctggctggctggctggctggaattctgtttttttttttttttttgagaaagagtcttgctttgtcgcccaggctggagtgcagtggcacaatcttggctcactgcaagctccgcctcccgggttcacaccattctcctgcctcagcctcccaagtagctgggactacaggcacccaccagctcgcccagctaattttttgtatttttagtagagacggggtttcaccttgttagccaggatggtctcaatctcctgacctcgtgattcggtgaccacctcggcctcccaaagtgctgggattacaggtgtgagccactgcgcccggccctgggatcctgtgttttgaatgaggctcctcagtactcggctctactggggtcccagcccaaggaataggactcagcctgcttctgtgccacctggggctgcttgaactttgcgacttgtggcttgggaggagggaggtggccgtgacctttgggggtttttgttctgcctggctgtagccaccagcagagggggtggggcacaggccagaaaaaccccttttgtggggttgtgaggagtgacaattggctgcttctcctccccttccaggctcagagcagggctggggggcagttgtgggcagtgaccagggtcagaccacctgggcggaggttcagcatgaacttgcaatgccctccatctctccaaaactgggggacccagcccagggagggtgtgggggttcctggggaagctggtctaggcttctgctcctgccacggaccagctgtgtgatgctgggcacaggatgcactttctctgggcctccgtggcctcttggggatggcttgcacgagatccctccagtcctgagtgagaggctgtggccttggggaattaagggtgcaggtggcgctcaggtgtccgagaagccatgggagccgggggctgcagggattggacagagaggaccctggtactcgcatctgttctcagaccacatctggaattgtagctccctctggagggaggcaggaggtctcagcctttcttggggggcggtggcacctgcgctgctcgctccacccctgctctcacctcccgctgcagtgctggcgagccccatcagcccttcactcatctctaccctccttctttctgcctgggacacttgttttcatcctgggcaggccaggggccagggcagctgttgggaatgtggcctgtgccatctccttttttgctgggatcagaaaacaatcgcttagaattccaaggcaagggtgtgagcgcctggccagccagtgggaacagacaacagcctgggagaggaatttccagcctctcttcagtgtgcgtgtctggaaatggggaccttgccttgagcctccagagttgaaaccccagacacccaggaaaggccctttgggatttagcccagccacagtatgtcctaaccgtgaccttgggcaagtaactcaatctctccgtgcctcagtttccacaaagcaaggataacactgggttgttggaagaatcaatatagatattgtctggagggatgtaggtacagtgcatggcattgggtggcactcaaatgtcagctaataatattattattattctacgggaagaagacatcaggggaagttgcagagcagcctgtgggcggactctggaacaagaggctgaggcagtgcagcagagggtctcagacgtgagcgctctctgccccggaatgattgactgagcgcaaaggtctgcacgctttctctgtaaagggccagatggtaggaatttcaggctttgtggactgtatggtctcagtgacagctactcaaacctgcctctgtagcaagaaagcagctacatgcatagacagcacacacccaactgagagtggtgtgttcctatctaattgtgctactggacacccaaacttgagcttcccaccattccatgtgccgcaaattattctttttttttgagatggagtttcactcttgttgcccagcctggagtgcagtggctcgatctcgcctcaccacaacctctgcctcccaggttcaagcgattctcctgcctcagcctcctgagtagctgggattacaggcatgagccaccacgccagctaattttgtatttttagtagagacggggttttgccatgttggtcaggctggtccccaactcccttcctcaggtgatccgcctgcctcagcctcccaaagtgttgggattacaggcatgagccaccaagcctggccacaaattattcttaaacatttttttttcaaccatttaaaacatgaaaaccagtggggtgtggtggtgcacgcctggtatcccagcactttgggaggccagggtaggaggatggcttgagcccaggagtacaagaccagcctgggtaacatagcacaaccctgtctctacaaacaatcgacaacaaaaaaattagccaggagcagtgacacgtgcctgtggtctcagctactcaggaggttgaggcaggaggatcacttgagcctggaaaatcgagggctatagtcagctatgattgtgccactccactcctgcctgagcaacagggtgagaccctgtctcaaaaaaaaaaaaaaaaaaaaaaagtgaaaaccattcttagtggcaggctgtactgggcctctgggcaatcatttgcctagttctgatttaacaaactcttgtatggagtttactatgtaataggcattgttttaagcactttacaaatattcagccatctaatcttcacaacaaccctatgaggtaggctattattctccctttatagagtaaaaaaaaaaaaaaaggcacagagaggttaagtaacttgtccaaggtcacacagcaagtgagtggtagagtcatgatttgcacttgtgtggcctgggtttagagtccacactcttggttgctaggctgggccatgtctccctgtgcagatggggtgaaggaaagctgctttccttctactcccttatgcaaaataaggatgaaaatcctgccccacctctaagactatttggtgaacagggccaggtattctctgccctcataggacactctagtagagcagctgggtgctaataacagaaacacagaaaccacggagaatcacacctcccaaaaagtgccgtgtgtggaaagaacgtgcaagggtgggcagaaacgtcacgtaaactgagaagtgctgatggcaggaggtgtggatggcagtgggaaggaagaggggaagaaagagctggctggtgggctgactgctctcccctaccaccccctgcccatccagcctcacttgcctgccgataaggcccggggtacacagggccccgagcagcagcacctgctgatcacagcgccgagctccagcagcagctccctggagagctcggccagtgcgttggacagaagggcgcccactcggaaccagccacaggcaccaggcgtggaggccagtggggccggggaggcccgggccagcaccgggagctcaggtaagaggtgggagcacacctggcttcttcccaagcctccttggtctttctcacctggtttctgtcttagccatctcctcctgagcctccccgcagggtgggacgaggcctgagccacagggaacttccttcggttcgctgaacctaagttccctcccgcctttgcccatgctgggcctatcacctcaaaatcctcccttctgtgggacaaccccagcttgtccaagtccctggtatctgggggaggagttttcctgaaaccttctccctgctaccacccccagctggcctggctgctcctccgggctcaccatgccctggcctccctttcacaggactgtcagactgcatgtacagacattgtcttctcctgtctcccacgccaggctgtgggacacctggtgagcctggatcatctcattcatccctgtatctgcaggcccaacacggcccagctactgataattaatcataacaatcgcttctacttatggaaggctacggaacagcaggcactgtactgggcactttacatgcataaaactgacctgcatgtcaatgctaagagatagttcctgttgttatcccattttacagatgaggaaactgagccccagagaggttaaacagcttcttcaagggcacatggctagtaaacagaagagccagactcacccctaggctgtcgggctccagagccctgggattggaagatgaatgaagaaatggtggctccagggctccactcactgcagtttgttgctgggtctctttaggtctgaggcactgggactgtggggattgtgtcccatttatgcaggctgcattgtgccctggacctggtctatgacagatgtcactcctggttggcatctctagggcccacactggaggggcccctgtacagggtctgctggcctgtgcctctctccctcttacctggcagtgccagccagtgagaattcagggaatgaccatgaacttgggtcagtctgagatccttgcctggccactctggtgccataagaatttgggtgggatgcttaaccctgccaagccttggttttttcacctagaggtgagctatagcgcctccttgccagggctggtgagagatgggtgacattgtgcccagctgggcaccagaccagggccaggctccctctgggccgcctccaggtggggactgatggctgcagcccccaccacgcagccctcctccagctcactcacccccagctgctccccagctcactgcgcccctgcctcttgcctgcactcatgccacccctgcctgccacacctgttcctacctgcccccaactgcccacaggagctgacgtggccatttctgtctgccccatcatagcccccagcctcctcggtgggaggtctcatcagtgcccctcactccatcctgagaactccctatgggagggcctgggccagtgcctggaagagatcaggggccctacacactgttgaatgaatgaatgaatgagtgcgctccaattataaactcttagtctttgcccagttcttggattcgtctgattttttttttttaaatggggtctcgctcgtcgcctaggctggagtgcagtggcgcagtcttggctgacttatctgctcaccgcagcctccgcctcccaggttcaagtgatcctcccacctcagcttcccgagtaggcgggattacaggcatgtgccatcacgcctggctaacttttgtacttttagtagagatggagtttcaccatgttggccagactggtctcgaaatcctgacctcaggtgatccatctgcctcggcctcccgaagggctgggattacaggcgtgagccaacatgcgcagcccatctttctgatttcttagctacacctggtgtggctccctccttgggccagggtggagccctgaccatgtctgccctcccctctcccctctgccccttctgctctgtgctccttctcccgagtcccccagcccgtgtccctggcctctgtcttctctttctctccctcccacccctaacacctccctccactgtgggaacctgtaaaccccagggttgtgccccttcatggtcccccatccacccccgcaatgtctcatgctcgatatacaaaggccatggtgactttgggtgacatttgggtgctgtggaggctcagggtggaaatttccttccggccttgtgatttcaaccctcctcccccaccacatgcttggggctgttttgagcacagcaggttgccagctccatccacctcccggctaccctatccgagtagttggagttagggagaaccaggctggggtgagggcactcagcaggcccctgcagcaacagcagcagcaactctcattttctgagggggctacttactgtatgccagtcccttcatattcatctcagcaaacccaccgtccagtgcctccccaaccagttagaaaactcagttgcccacaggggctgggcaggaaggtgaggcaaaccttgggctgtccttggccggatctcctgcatctggctcccaagggaagccataaatccagatttttaaatgtaaacgcctgaattttaaatgttggtaatcaattcacttaaaaacatcaccaccaccaccaccaccaccaccaacaaaaaaacccgtagacttgtccctgttacaggcactaggaacacagcagggaacaatcaaaaagtccctggtctggccaggcaaggtggctcatgcctgtaatctcagtacttcaggaggccaaggcaggaggatcacttgagcccaggagttcgagactagcctgggcaacatagcaagacccccgtctctactaaaaaaataaaaaaaaaagtccctaccctcctgggttcagagtctggttggggaccccaggagctgggggctctggagatcaggagatcacagaaatggggagggacccagagagtggtggataggatgggaagtaaatgtctctagagagggaggccagggggtggagggcgcttcgtggaggaggtggcctttgagctaaggcctgagcactagagaagagctctctaggctgagggagcggcctgtgcaaaggcccaggggacctgaagggctcaaggggctgtagcagggggtggggaatgtggctggaaggaaccccatcaaggtcttggagcggcaggagagggggtgggagaaggcaggctccagatcagacagggcctggtaggctgtagcaaggactgtgggtttttgagcccccaaggaagtgatctgccaggttcaagggccagctctggctgctgatgggaaacagatttcagaggggtggggttgaagccaggacagatggaggctgttcacacccatccagatgggagtgaggggaggcttccatagcccaccatgcagcagcagggcagggtgacccttgcagaagtcatcttttgtttttgtttgtttttgagatggagtttggctctttcgcccaggctggagtgaagtgacgtgatttcggctcactgcaacctccgtagcctgggttcaagctattctcctgcctcagcctcccgagtagctgggattataggcacctgccaccatacccggctaatttttttttttgtattttgagtagagacagagtttcaccatgttggccaggctggtctcaaactcctgacctcaggcgatccacctgccttggcctcccaaagtgctgggattacaggcgtgagccaccctgcctggtccagaagtcatcttttgaagggagacaaggcaggaatgatggatgggtgtgtgatatgagagaaagatgggtccgaggctctgggcccaagcagctgggtggatggcagcaatgggaactgtgatgagcaggagaggttttggatgcgagatgggagtagaatcaagagttaagttggaggctgagcacggtggctcacacctgtaatctcagcgctttgcgaggctgaggtaggcagattctttgaggtcaggtgttcgagaccaacccaggcaacctggcgaaaccctgtctctacaaaaaattagcagggtgcggtggcctgtagtcccagctattcaggaggctgatgtgggaggatcacttgaggccgggaggcagaggtcacagtgagttgagggagtgacacagcactcttttgagaccctgtctcaaaaaaaaaaaaaaaaaagacagaagagacagggtctcactatgttgcccagtctggtcttgaactcctgggctcaagcgatcctacaaacttggcctcccaagtagacatctgttttatataattggctcctcccatctctggggtgattggggctgggtaggtagtgatgctattcttattcggcagaggggaaaatgaggcacatgcaggttaagtgacttgctcaaggtcacacagcagagctgggctagaatcttggtctcggctcctggcccagtgctctttcccatgtgtctgaatctgcatcttgggcaggggtccctgggccccactcctggacccccggactgacccccaccccatcttgtgcttagcagattcttcccctggtggccatgggacccaggtcaatgtcacctgcatcgtgaacgtctgtagcagctctgaccacagctcacagtgctcctcccaagccagctccacaatgggagacacagattccagcccctcggagtccccgaaggacgagcaggtccccttctccaaggaggaatgtgcctttcggtcacagctggagacgccagagaccctgctggggagcaccgaagagaagcccctgccccttggagtgcctgatgctgggatgaagcccagttaaccaggccggtgtgggctgtgtcgtagccaaggtgggctgagccctggcaggatgaccctgcgaaggggccctggtccttccaggcccccaccactaggactctgaggctctttctgggccaagttcctctagtgccctccacagccgcagcctccctctgacctgcaggccaagagcagaggcagcgagttgtggaaagcctctgctgccatggcgtgtccctctcggaaggctggctgggcatggacgttcggggcatgctggggcaagtccctgactctctgtgacctgccccgcccagctgcacctgccagcctggcttctggagcccttgggttttttgtttgtttgtttgtttgtttgtttgtttctccccctgggctctgccccagctctggcttccagaaaaccccagcatccttttctgcagaggggctttctggagaggagggatgctgcctgagtcacccatgaagacaggacagtgcttcagcctgaggctgagactgcgggatggtcctggggctctgtgcagggaggaggtggcagccctgtagggaacggggtccttcaagttagctcaggaggcttggaaagcatcacctcaggccaggtgcagtggctcacgcctatgatcccagcactttgggaggctgaggcgggtggatcacctgaggttaggagttcgagaccagcctggccaacatggtaaaaccccatctctactaaaaatacagaaattagccgggcgtggtggcgggcacctatagtcccagctactcagaagcctgaggctgggaaatcgtttgaacccgggaagcggaggttgcagggagccgagatcacgccactgcactccagcctgggcgacagagcgagagtctgtctcaaaagaaaaaaaaaagcaccgcctccaaatgccaacttgtccttttgtaccatggtgtgaaagtcagatgcccagagggcccaggcaggccaccatattcagtgctgtggcctgggcaagataacgcacttctaactagaaatctgccaattttttaaaaaagtaagtaccactcaggccaacaagccaacgacaaagccaaactctgccagccacatccaaccccccacctgccatttgcaccctccgccttcactccggtgtgcctgcagccccgcgcctccttccttgctgtcctaggccacaccatctcctttcagggaatttcaggaactagagatgactgagtcctcgtagccatctctctactcctacctcagcctagaccctcctcctcccccagaggggtgggttcctcttccccactccccaccttcaattcctgggccccaaacgggctgccctgccactttggtacatggccagtgtgatcccaagtgccagtcttgtgtctgcgtctgtgttgcgtgtcgtgggtgtgtgtagccaaggtcggtaagttgaatggcctgccttgaagccactgaagctgggattcctccccattagagtcagccttccccctcccagggccagggccctgcagaggggaaaccagtgtagccttgcccggattctgggaggaagcaggttgaggggctcctggaaaggctcagtctcaggagcatggggataaaggagaaggcatgaaattgtctagcagagcaggggcagggtgataaattgttgataaattccactggacttgagcttggcagctgaactattggagggtgggagagcccagccattaccatggagacaagaagggttttccaccctggaatcaagatgtcagactggctggctgcagtgacgtgcacctgtactcaggaggctgaggggaggatcactggagcccaggagtttgaggctgcagcgagctatgatcgcgccactacactccagcctgagcaacagagtgagaccctgtctcttaaagaaaaaaaaagtcagactgctgggactggccaggtttctgcccacattggacccacatgaggacatgatggagcgcacctgccccctggtggacagtcctgggagaacctcaggcttccttggcatcacagggcagagccgggaagcgatgaatttggagactctgtggggccttggttcccttgtgtgtgtgtgttgatcccaagacaatgaaagtttgcactgtatgctggacggcattcctgcttatcaataaacctgtttgtttta

SEQ ID NO: 34 - DNA, 110237 bp, Homo sapiens
ccctcctggacaaagcgtttttcctcagccttcaccacccatggaggaggtgtgattacctctattcacagaaaggagactgggacccaaccaaggcaagtcatttgcttcagaccacagagcaaagaatcattctgtcattccagaaatatttgtcaggcgcccctggtgtgtcaggtaggtgcaccttgaacatttgtttaatttgtacttaataacattttcaagaggacattacctccttaagtgaaaaatctgtgaggagttttctatctttctaagtctttgtggcacacttatcacatgcatagtactatttctcaagttacccaggcacacacagatgtatggctttcaggaagccatacatctgtgtagctctgaggcccagccttgttcaacacttcactcagaagaattgctggcctgatgaccaacaataattgtcaacaacttaaaacttcattgacggctcctaaaaaaaatcagtgtgcatgtgtgtgtgtatgtgtgtgtgcgtgtgtgtgtgtgtgtgtgtatgagtgtgtgtataacattcattactgcaaactggaatggagtggggctggaaggcagcccagaagcaaggctcagagcctggagctgctgacctcttggggacactgcagccctggcctggcctacttttctcttctcccatatctggaaaatgaaagtagcctgacgtatccggggacccggcccaagactccacccattggcagctcttcacttgtatcttttcatatcaaaaatgggaggtgacacccagtttaaggaaaattccaaggcatttgtctcgactaatgtgaaagatgattacagtggccagaggactgccaaggctccttctcaagctgcttgagtcaatgagggtaaggttttaaagggcccgccctggcttccttgggcctgtagtttgtgactgtgtcgttttcagagtgggaaggcccagagttggccccatggaattctttctgcttctagggtgtttgaagagatagaaagccagggtaaggttcaccgaacctccaagcaaaaataaatttccagaaggggcccctttactctgaggacattgaatagcaacaaaaactaccactgaagagtcattttgtcccaggccctgtgctggaaactttgaacacctgtgttcacccctccctcatgacactcatgaagatataccatggctgtctttattttctaggtgggaatctcaggcttgagggttggggtggcttggggaaggtgtgtatctaagaggtagctcttatttatttttacttctagagattaagacacattctttttcaagatagacatggaactgtcaaaaaggattaaaagttaaataaggataaggttatgtaaattgatcttatgtaaaaaaaaacactaagatatttgaagactaggcatcattatgtgttatatcatgatttttaaaatgatgctaccaagagtacttcagaggtccaaagctgaaatatatttgtatacttatatatataaagtaagggatacttatttaaaacctcaaaaaatcagaagtatgtaaaggaagaaataaaagctccctcttcccttctgattctaatttatatcaaatttatatctctatctgtagctcaatttgcctttttaactaaatagggtgatatcacacatatcattccttaacacttttctctcttaacgacttctaatggacatctatttgtggcactgtatatagggcatactttcttgaaaaatccattgcatggtattttattcttgaataaatcacttgcatggcattttattgtaagattgtgtcataatgtatttattcagttccctggtgatggctttatcatgtggcttttggctgaaagtatcagaaagtggcccaaactggcttacataaatttaccatctcatgtaactgaagttcaaagaaagagtggcttctgagtgggttccatactactagcataatatttggcatttccctgtatgtcccctcctctgtgtgttggttttgtttgaagattctttccctttatggtggcaaaatggtttttgtagtggcaccaggctttacaacctcttgtgagggaagagggagaaatgccatgccttaatgtgccaagaaggaggtgtgagatccaccctggttgaaccccatggtgccggtgtcctctcctagaccagtggctgccaagggccatcttccgaggaagcacctggactatacatcctccacaatgggcccttagaattggtccatatttttcaaaattgcaaataatgtgtaaaatcattgtacttggccgggtgtggtagcttatgcctgtaatcccagcactttgggaggccgaagtggggggaatcagctgaggtcaggagttcgagaccaccctggctgacacggcaaaaccccgtctctagtaaaaatacaaaaaaattagctgggcatggtggcctgtgcctgtaatcctagctactagggaggctgaagcaggagaactgcttgaacccgggaggtggaggttgcagtgagccgagattgtgccattgcactccagcctgggtgacagagcaagactctgtgtcaccaaaaaaaaaaaaaaagaaaaaaattcgtacactttacatatagcactgtttacttgggcaattatctgtttaggataaactagaaataatattgctaagccaaatagaatataggttttaaaagtttggcgctttatcctccaaaacagattttaatagtttacacttgtaatagatgtacctggtttcttatacctcacttactggaatattagaaatcgtttagtctctaccaaaacatggcatttttctattatcttaattcacatttctttggttattagtaatcttgaacatgtttttcacgtctattggctttttgctttttgcttattgctttttgcttctttcttttttcttctgtggactgtttattcatgtcttttgcagtattctctcttggatttgtgagaattgtttatttattataaacattaaaccttgattggtaatacatgttgcaaatatttttccctaagttttcattgatttgccaaacttagtttttttttccaagttgtcttttctatgcaaaagttttcgcttttttgtaggtgaaactatgagaaattttcctttaccatttccgagtttaatgtcatgctaagtccttcctgtcttgggaagatgtgttcacagcccactgactgaaggcccttcccggccagttctgagcttgagctgagtcaaatgtaaacagctcctggggctgtgggtatagaaactccctttctctttgggtctggaataccatgatgccttttccctgtcctcatttttcttaaatgttttcatttaatccaggcattatgtactgggggatcaactattcgcaaaactcagtaaaaggcggattcccaaggctccactttggatgcagtaggtctggggccaaagcatgtgagaaaaaaagtgtcagcatttattcattccacagctatttcatgagggttcagggcatcattctggggaccacggatacaatacggtgaacatcatagacaaggttcttattctcatgtagcctaaattctactgggggagatggataataggtgaacaaataaacaaacaaactcatctggcaccaaaaagtccactaggcaaagtgctgactgtgaagaaaagctggggtggaaagagaggccatggcccctgcaaaatggaataggaacaaagatttaatcatttgcctctgaaaaatctcagtgatgagttccttccctcccttccctcaacctccagtgtagaggagactgatgatgattgacagggaagcactggtggcttctcagaagtccatgtgcctcttccactgccttagtcaccccttactctgcattttcacagaatctcagtgaaattgcttaaacctctgagtacctgagagatactcagggctctttcttggatgccaaatagataaaatattgactcttaaacatatgtctgaattcctcttgcctttccaaggtaggagaccataccatactcatttgacagcaccatttacggtcaacaaatctctaagctcaaagaagagaagaggcaaaaagcaaccctaccttatgcaattaaaaaaaaatctccctttatagagtttcattgaccctttcttaaaaccccctaaaatggacgtcaacaatgcccctcttttatgatgagaggatggaggagcaaacaggtcgagggacttattccaatcgaacgtctcagtagctcagtcccaaggagctctgccccagtagtgccacttcaagtcccatgttcttttcatcttgtgagtgatgagcagcacgtggtctctaggtttgcaatataatttaggatttactccttgggtttagttttggtaactctcaaagaagttcaaatattaagaattttgctagctgttttagtaatctattgctgtgtaactacctcttcccctacccccagtccagaaaacaacaaccatcttctcttttctcgtggttctgtgggcagttctgctccacatgacgtggtctggggctgcagtcctgtggatgcttctttgggctggtgaggttccatatggtgctttcacacgtctggtgctttggtgagacagtggggaggctgggctcagatggcaagctgtgatgactgggcctatctgcccatgtcatctctgggcctctccatatggtctttctgcattctctccagccgggtggcctattccttacatggtagtttggggctcctaaaagtgcagacatggaagctgttcaacctttgtgagatgctgccccagagctagcctaacatcccttcctctgccctctatgggtaaagcagaagcaccaaattcaagctgggaggaaaacaaacttcctctttcaaaggcgaaagtgacaaagaatttgcaggccgtttaaatccaccacattgtccagtcaggagcacccattttctcattgaccttctgctaagtgaagaggtagaaggaattttcacaatggcttttagaaaagtaaaacaatacaggaagggattttgctgtcatttaaaacatggtctgctccagatggaggatttggtgatttttattttcttctttactaaacatttctgcatttcatgaagtttttcagtgcatcatttttattatcagaaaaacaatgacattttattaaatatatatatatttaactcattaattatctaactcattgaatatatattttcattctatatgtatatatatgtgtgtttacatataaacgtgtgttatgcgtattctttatacatttttctcttgttttttgagttggaccttggcaaagtcagtggtgacacctggattaccttgtgttaactttaatcagttatgtgacatccatgggattggcaagtaaaacaagttattggtagtgggagtttgaatagatggcttctaaacaccctcccagacactgtaccttcaactctctgatctcatccaatccagaccaacacttctttactaagtttctctgttaatcagtttgcacaggaaaatgtttccattcaacacatatgtatgatgagcatgttgtgacactggctctgtgtagacatagtgggcactgaggaaatctggggatcctgccattaggagcttgtgagctggcggggagctatggtgatgcacaaaattataacacatgctaaaagaacacagttaaaagagaaataaaatttaaatgttaaagaggtgattaccagttatttgaaaaaaaaattcacctctttccaaggagattagatttctacttttagaattcttcatacaaatacacatattttgagttcttgatctcagaaccccattgcatatattgcatgcaactggtttgcaagtttttggtacacacccaccccacacatacctgattgcctactgcacttcctagaaatgtcgaggaagcctagatgacagaagttaatttcttcccagggaatgtaaagcatatcttggcagataagaacgaaaatacaggttaaagacagaagatttcactgggagtggctatgaggagccatttaaatttctagcagcaaatgggtggcacaattggctttaagatgatcaatctattggcagtgtatcatagagcttcccaacttatctgtgccagggagggatcaacagtgcacacctgaaacttattacagactaatttcaagtgatattgtactgcttcaggtatgatataagaactttataacgctttcatttctcccttcctggtctttgtgttattattgctgcacattttccttctacatatgttatgagacccacaatacatttttaattttgcttcagttatgttttgaaatgttttaattaataaaaatatcttacttatgtacccatgtagttaccatttctattgcttcgtattctttttttttttttttgagatggaatctcactctgtcgcctaggctggaatgcagtggtgtgatctcggctcactgcaagctccgcctcccaggttcacaccattctcctgcctcagcctcccaagtagctgggactacaggcgcctgccaccatgcctggttaatattttgtatttttagtagagacggggtttcaccgtgttagccaggatggtctcaatctcctgacctcgtgatccacccacctcatgtttccatttggtataattttctttttatctggagggcttccttcaacatttcttatagtgcaggtctgctggtaacaaattatttcagtttatagatgtctgaaaatgacttcattttatcttcatttctgaaagacatttttgctgcataaatttttataggtctagaattatttcttttagccctttaaagatattgatctagggtcttttggcttgcattgtttctaatgagaaatctgctgtcattcttttttcttttttttgctcttctttggcagcttttaagattttctctttagcaggtattgtaagcatttgattatgatgtaccttagtgtagttgtcttcatattttttgtattagggcttgttgcccttcttggatctgtgggtttacagttactgtatttggggggtttgtagccattatttattcaaattttttttctattaattcctctctcataatccccccttgagggacttccattacacatatatttggatattttacattgttctacaattcattaatgctctgctcattttttcaatcttcttttctcaccgcttaattttgggtagtttctattgccatgtcttgaaatttactaatttttgtttttctttctttctttttattttattttttttgagagagagtcttgctctgttgcccaggctggagtatagtggtgcaatttcagctcactgcaacctccacctcctggattcaagcaattctcacatctcagcctcctgagtagctgggattacaggtgcctgccaccatgctggtctaatttttgtatttttagagatgatggggttttgccattttggccaggctggtcttgaactcctgacctcaggtgatccacccaccttggcctcccaaagtgctgggattataggtgtgagccgtggcacccggccgaagtttactaatcttttcttttgtaatgtgaatttgccataatacaatctaatgtgttttctcaaatctaagatacagctgattttatctcaattagttattttaccttaaaaaaatctcttttgtgtctctgttcaacatgcttgatctttcctctagcatcttggccttatagaatagtcataataaatgttttcatgtccttgcttgttaattcttgctctgtgttagttctgcatcagttttgattgattcatttttctcctcctgttggttatattttcctgcttctttgcatgcatggtaattttttattggatcgtaggcattgtgagtttgacattcaggttagacctaacatatacagaacactccacacaagaacagtgaaatacacatttttatccactgcatgtggactattttccagggttgaccatatgtgaagacataaaacaatgcttagtacactaaaaaaagagagaaatcatacaaagtatattctctgatcacaacgaaatgaaattagaaatcaataaaagaagaaaatttaggaaagtcacaaatatgtgaaaattaaacaatatactcttaaatatcaaatgggtcaaagaagaaattaaaagagaaattaaaaatactgtaagattaaagaaaatgaaagcacaatacaccaagcttatgggatgcagctaaagctatacatagagaaaaaattaaagaaataaatgagtatattacaaaaaaggatcttaaatgacttatcattccactctaataaactaaaaaagaagagaatactaaatgccaaatatcagaaggaagttcataattaagatcagagtagaaatagataaaatggggaatagaaaaaaatagagaaaatcaacaaaccaaatgtaggttatcttctctgaaaagataaacaaaactggcaaagcattcactggactgatcaaaaattgaaagatgactcaaataactaaaatcaggaattaaagaggggaccttacagaaataagagggattataagggaatactacgaaaaaattatatgccaactaattaaaaagcctagttgaaaggcacaaattcctagaaagacacaactgaaactggatcaagaagaaatagataatctgaatgggactataataaataaagacactgaattagcagtcaaaaaacttcacacacacacacacacacacacacacacacacacacaagaaaaaaaaaaggaaaaaagcccatgcccagatggtttcactggtgaattccaccaaacatttaaaagagatgagcagcaatccttcagaaaactatttcaaaaagttgaaaaggaagggacacttgcgaattcatcctagaaagtcagtattaccccggtaccaacaccagatgaaaacatcatatgaaaagtaaaataaagaccaatatccctgatgaatacagacatacaaatcctcagcaaaacactggacatgaaatagagcagctataaaagaatcatatgccatgaccaagtgggatttatcctaagaatgcaacattatttcaacatccaaaaatcaatcaatgtaatgcaacatattaatagaataaaggatggaattgcataatcatctcaatagatgcagacaaaatgtctgataaaatctgacaccctttcaagattaaaaacaacaacaacaacaacaacaaaccaacaaaaatcagcagagtagtaatagaagaggactttcttaacctgataatgggcatccaaaaaaccccacagctaacattatacttaatgatcaaagaccagtagctttccctctgtgatcaggaagaagagaaggatgtttaatcctaccacttctattcaacattgtactaagaatgctagctagggaaatttggcaagaagaaataaaattcatattggaaaaaaccagctctattctcaaatgacctggtcttgtatatagaacattctaaggaatccactaaaaactattagactactaaacaagctcagtaagtttgcaagatacaaaatcaatatatgaaaattaattgtatttttatatattagcaatgaaaaatttgaaaatgaaattaagaaaacaattctacttacaatagcttcaaaaagaataaaatagcataaacttaagaaaagaagtataagacttgtacactaaaagtataaaatattattgaaagtaattttaaaatcgctcaattaattgaaagacatcccatgttcatgaatcagaagacttaacttttttaaagatggcagtactccccaaatgtatcccagatttatcacaatccttatgaatatccaaattgcctttattgcagaaattgagaaactgctcataaaatacacaaggaaatgcaaaggatggagaatatccaaaacaatcttgaaaaataacaaagtcaatgacttacactcccattttaaaacttactacaaagcaacggtatccaagacagtaggatgttctcagagtataaatataaaaatcaataaaaatagaattaagaattcagaaatatgcccttacgtttatggtcaattggttccaagaaagatgccagcaattcagtgggggaaagaataatcttcttaataaaaggtgatgggacatctggatatccacatgtgaagaaaaaatttgcatctctatctcatactgtacacaaaaatttactcaaaaagcaatcatagaactaaacgtatgatctagaactgcaaaactcttagaaggaaatataaatataaatctttgtgaccttgaattgggcaatgcttccttaagtatacagcgccagagcacaagcaacaacaaaatagataattgcacttcaccaaaattaaatcctttcatgttttaaagtactctcttaagaaagtgaaaatatagctcatggagtgggataaaatattggcaaattatctgataatgaacttgtatccataatatgcacaaatctctgataaattaacaataaaaagacaacccaattaaaaagtgagcaaaagatttgaatggacatttcgctgaagaagatagataaagggttgctaagcacattaaaagatgctcgacattactggtcattagcaaacgcaaagcaaaacatactaagatgccatccactagaatgacgggatgaaagaggccagaaataataaatgttagtgaggacatagagaaactggtacactcatttattactggaaggaatgtaagatggtacagctacttttaaaatagtttgtggttctttgaaatgttcaacatagagttgccatatgactcagcaattccactcctaggtatctatgtgacataattaacaacacaaaaatctgtacaccaattttcatagcaacattattcaaaatagccaaaacatagaaacaacccaaatgtccattaatggatgaatggattaacaatatgcagtatatccaaacaacggaatattattcagccatggaaaggagtgaagtactacctatacacagtacaacatagaggaaccttgaaagcattatgctaagtgagaggagctagttacagaagcccacacattgtataattccatttatatggaatgcttagaataagcaaatttatagaatcagaaagtagtatatagattgccaggggctagaagaaaggggaacgaagagtgattgctaatgagtatgaagtttcttttgggggtgatgaaaatgctctgaaattggatagtggtgatgggtgcgcaactctatgaatatactgaaaccctttgaattgtacacttttaaaagggtaattttatgctgtgtgaatgacatctcaataaaattctcattaaaataagaatatatgagagtatctatttctaactgtagagatttttgcaaatcctgcagaaatatgctgaattagttacaaccagctaagggagcctgggatggaagagtttgaaccacacccaatggcctgcatctggtgctctcccaagatccatggaaataatcttccaacctgcaatgtaccagggcatctaccagcctggctccacggtggtttcaggcattgctctacaaatgatcaagttttcattctagagtacgaatgaggattgagttagactaactgtacaagggacaggaaataacagctccttccctgtcctggggtcagtggtttgaaaagcaccccatctatcagtgaatatccagcttcctgacaaagaaaagggctaggggatttgcccccaccctgtttagaaggcgaaggcgaattaggcctgaatggcgacttgattctcatctgaatatcagagaaacacatgtgttgcaggctacactggaagtcctaatggcttcagtttgatagtggatttgggcttaatggttgagcaactccagtggcttcctctcttgattacgttggtggctgtgagatgaactacccagtcatcagtcatcattatcaatggcccatttgcctgggatgctttggaagaatgaaagagagtaaaggcagttctacttttaaagaagttaaaacatgggctacagagcattttcgtttattgtttatcaaatgttagcctgcctcagaatacctggagggcacagattcctaggtcccacctctggagctgctaagtcagttgatgtgggcaaataacctaacaccttggcattcacttccaggttttcttcatttcctcgtcctccctttccttcttcaaatgttctcctgttccttcttggctttataactatctttgtctctgcttcccttcctatacattgccttaattaatcctttaatttagattaaattaaaggataaatataaattaaaggataaattaaaggataaatctaatcctttaatttaaatattatttctggagatatatttgccatgtgatccattttgtttgttagaaaaacacaagagaaaaaaattgctgataatcttctcaaaaaggattatcttgtttgttctaaagccaaggatgtatagtgcatcttggaatgttttggattgaggtgggacatttgctttctttttgttttcaaacatcattaatttacttggtataagaacttcagaatcagcataaagtaaaagtagtttcttaggaatagtgtcatgataattccatgcacttaacatgaggtaggtgataacggaagtagtggttttcttgatttttcttattcaaactgcttcatcaaacaaaacaaaacagaacaaacgccctggagacagagagtcttattgtgccatagtatttctctttctctctcttttttaaatatttcaagcgagcatgccatcagcagggctgtcttcactgagctatttgttgctgggagatgttgtagactgttgctcggtcagtgcaaatgagagctgctagcctcgctgtaacctcgctggctgggtactctcagagattgttaagagttttaaaatttttctaatcactaagcatgttaggaaaccagagctttgtgtatgaagaacaacttcctctcagggactgtactcaaggctgaggtttggacctcagccaattttatgaacgaacaggaacaatgtcaaaaacatcaggattcctggtcatgaggaccagagggggccactccaatgggatggtaagcttctgtagggctggcacgtgactttgcacccctgatgctccgcatgaagggattttctgcacccagcaagtgctgactgatttcctgaggacacttagtcctactctaaactctaagaaggtctagggccacatcaggaaagtgagattcatgcactgactcatttccacacttcagaggacactttctttgagtgggtgtttggaaaaaaatgcaaggtagatgtaattctccacacatcagctgatgactcgtactgacagtgtctagaatagaactttttttttccttttgggtaggtaccttctccccagatggatggtgtgttccccagagtgccgaggtatttctgggtgaagtaatattgttcccttgtgtgtaatcctactagttctctttcatgaagtagctggaatgtctgagtggtcaagggtaatccctgagctggccttgacacaaacagatacgggctcttccatccttgggtccctctgttctgacacctgatgacacacttaggagttttcctctagtacctaaaactatagttagtaggtacttagaaacaattacaagctgtgctaatgctttttaaaagtggaaatatcggccaggtgtggtggctcacacctgcaatcccagcactttgggacgccgaggcaggtggatcacgaggtcaggagttcaagaccagcctgaccaatatggtgaaaccccatctctactaaaaatacaaaaattagccaggcatggtgatgggcgcctgtaatcccagctactcaggaggctgaggcaggagaattgcttgaacctgggaggcagaggttgcagtgagccgagatcacgccactgcactccagcttaagcgactgagcaagactccgcctcaaaaaaaaaaaagtggaaatagcaatatgtgctttagctaaatattaattttgtttttgccctgccttttagctctgtggtcttgaccaaggcctcatagcgactctgaatctcttgcgactctgaatctcttgcgactctgaatctctcgcaatctcaattttcttgtttgcaaaactaagatgtagcagttataatgtgaggcgcaaatgagaaaggccatacaaaaaccctaaccaaaaaatccagtaaaatgaagctcagttaaactaaagacagcccgttgacatcttttgtgcgtttcctccttggttcccaggaatgctggaaaaagaggcatttgttctaaacatggaaatgcagcaaaataatgattcttttatggcctggtggtctggtttgacacaatcaataactaaaataaatacacacagcgtacagccctgtaataatagaggttgctcggaatcaactcacagtagtaaaaatcctggttgagaaattatccccaaagatgatatgattttatcgccccgtacaaagttaaccagtcttatacataatatggatcttttcaaacttttaaatgaagtataatgcatacacagaacagtgaactcatcatgggcaactaaattaattttcacaaaatcatattttgtgaatatgctatgatttattaatacattgtactgctgatgaacatttggatagtttctggtttttggctaataaatatagggctgctatgagtatttttgtatacatactttggttgacatttctactattttctgttggtcttgtacctgtgagtgaaattactgagtcataagatatgtatttgttcctcagcagtagttactgctgccacacagcatggttctgctaatatgtacttccagtgggaatgtttgacagttccagctgatggaaatctttaccagcgtttaatattttctcttattcattttcaccattctggtaagagtgtcccgcaatttcattctggctttaattgaatttccccaatggctaatgcagttgaacactttttcaaattattttttggccatttaaatattttcttttgttaaggatcagttcaaccttttgtttgtatttctattgggttacctagatttttcttactgatttgcagtggtttttaatgcattctgggtaagaacactttgtcagcagtatctattccaaatacctgcttcaactctgtggattgcatttcatttccctaatggtgtctttggatgaacacaccttgatttatcaatagtctttctttgattattagaatattttgtgtctgttttacaactatttgcctactccaaagtcataaaaattttctcctgtgcatttctttaaaggctttattgttttacttttcacattcagatctgcagaccaacaattaagatttggatatggtattaagcagtggctcaaggttcaattttcatttctccatttgactatccaaatgattcagtgccatttagagaaatgaatactcttttctctcttcagttcagtggcgtgttgggcataaatcaggtaactatgtaggtgtgtatgagtctttttctggactattcattctattgcattggccagtttgtataaattttcactgaaatgctgtcctaattactatagccctgatataaaatgctatctagtagggtaagtctttactattcctcaagattgccatagctattatttgcatttaatattttcatatgaattttaaaatcacctgtcaattcccacaaaataccaacagcgattttgattgggattgcaattaatttataaatcaatttgggaataactgacaactttacaacatcaaatctttcaattattgaacatgctacattgtatagctccatttataagatattctttaacttctcttggcaatttttaaaatttttcagtgtagggaacttacatgtttttcatattttcagaagaatcactgtctgtgtcagcaatagctttatttttaggtggttactatttttagtgagcttgtacatgaagtaatttttgaaacatttcatttatgacttgttcgttgatagaaataaaagtgattttaatattgaccttttatccactagcactgctaaacttgtttactgattttaataatctgtacatgcttgtgaatattccagaaaaacaatcatgccatctgcaaataatggcattaatttttaaagggtggtttcactgggtaagatttcttaattgacagtttagttttctttaggtgcttagagtatgttgttccaatgccttttggcctccgtactttctcataagaattcagttgttaatcacttcattgtatttcctgtatgtgatgggtcgtttttctctagctgctctcaggatattttctttatcattggcttttaacaatttgcttatgatgtgctttctttgtgattattctttgttgggttgtattgagcttgttgaatatgtaaattaatatttttcactgtttgaaaagttgtcagtcattattactttaaatattttctacgcctttctccccctctttttttttggggattttaattacatatattttggcagagccaggggctctgtttatttttcaacagactttttttctttgtgatctttcaactgtgtaaaaaactcactagttctttatctgtcactaatctgctctgggaatcacctcgtaaattaaaaaattctcgttactgttctttccagctgtttttaaacgttatctagcctccctttctctctcaaagattttatatttgttcactcatcaatatcttatttaaaaattatttgaacatgtttctctttatttttttgagcatattgatacacaacatgtggacctactcagagtgacctacatttttgaagcccatattttttaagatgtagaattccagttttgcaattattttccactcacacattaaatatattataggtgtatctcagagatattgtggatttgcttccaaaccactgcagaaaagtgaatattgcaataaagcaagtcacaatttcttttttttttggttacccattgcatgtaaaagttatgtttacactatactgtagtctattaaatgtatggtagctttatgtctaaaaaacaatgtacatatcttagttaaaaatactttttcacttaaaaatgctaacaatgatctaaggcttcagtaagttgtaatctttttgctagtgggaggtctacccttgatgttgatggctgctgactgaccagagtggtggctgctgaaggttggggtagctgtggcaatttcttaaaataagacaacaattaaccatgccacagcgatcaactcttctcctcttgaaagatttctctgtagcatgtgatgctgtttgacagcattttacccaaagtagaacttctttcaagattggagttaatcctctcaaaccctgacactgctttctcaattcagtttaggtaatattcataatccttttgatatggtttggctctgtgtccccacccaaatctaatgtcaaattgtaattctcgtgcatcaggggagggacctggtgggaggtgactggatcatgggagctgttctcatgatagtgagtgtgagttctcatgaggtttgatggtttaaaggtgtggcatgttcccccttgctctctctccgtctctcctgccaccgtgtaagacgtgccttgcttcctcttcaccttcttccatgattgcaagcttcctgaggctgctccagctatgtggaactgtgggtcaattaaacctctttccttcgtaaattactcagttctttctttatagcagtgtgaaaatggactaatatacccatgttgtcatttcagcaaatgttcacagcatcttcaccaagagtggattccatgtcaagaaatcactttctttgctcaaccataagaaacaactcctcattcatccaaatttggtcatgagactgcagcaattgattccaccttcaggctccacttttaattctagttctcttgctattttcaccacatctgcagttacttcctctactgaagtcttgaaccccttaaagtcatccacgagggttggagtcaacttctaaactcctgttaatgttgatatgttgacctcctctcattaaccatgaatgttcttaatgacatctagaatggtgaatcctttccagaaagttttccatttacttttccagttccatcagaaaaatcactatctatggcacctatagccttacaaaatgtatttcttaaataataagaattgaaagtcaaaattacctcttgatccaatggaaattgtgttagcaggcatgaaaaaacattaatctctttttacatcttcatcagagcccttggatgaccagttcccttgccaatgaacagtgatatttttacaggaatctttttttttttcccctgagaactagctctcaacagtgggcttaaaatattcagtaaaccatgctgtaaacagatgtgctgtcattcaggctttgttgttaagtttatagcgcataggtagagtagatgtagcctaagttttgaaatgagaaatggacgttggcgtcaacttaaagtcaccagctttattagctcctaataagaaagtcagcttgtcccttgaagcttcaaaaccagacgttgacttcttttctccactataaaagtcctagatggcattttcttccaacagaaggctgttttgtctacattgcaaatctgttgtttagtgtagccaccttcatcaatgatcttacctagatatgtgtaacttgctgcagcttctacattaacactagctgcttcatcttgcacttttgtgttatggagatggcgtctttccttcaacctcatgaaccaacctctgctagcttccaacttttcttctgcaggtttctcacctctctcagccttcctaaaattgaagagttagggccttgctctgtgttaggctttggattaagagaatgttgggtctgttttgatctattattgacactactgaaactttctccatatcaacaataaggctgttttgctttctgatcatttgtgtgttcactggagtagcacttttaatgtccttcaagtatttttactttgcactcacaacttttctaaccatctggtgcaagaggcctagctttcatcccatcttggctttcaacatgcctaagcttcatcatttcttgtttttattaaagtgagagaattgtgactcttctttgaatgcttagaggtctttgtagggctattaattgacctaatttcaatattgttgcatctcagagaataggaaggagacagagagatgggggagtagctggtctgtgggacagtcagaacacatttattaacttttctgtcttatgagtgtggtttgtgtcacctcaaaacaattacgatagtaacatcagatattgctgattgcagatcaccataacatataataataataaagtttgaaatagtgtgggaattaccaaaatgtgacacagagatatgaagttaccacatgctgttggaaaaatggagctgatagagccagatgcatggttgccacaaaccttcaatttgtaaaacaaaacaaaaacccccacagtatctgtgaggtacaataaagcaaagtgaaataaaatgaggtctgtttgtacctcgttgtcttctagttttcactgtttctatcaaggaggcagttgtaagtcttcctctgaatgcctttgtttctctgactgcttttaaattgttgctattttgtctgtggtattcaagagttttattatgatgggtcaaggtgtagttatctttggtttatctttttttttttttttttgagacagagtctcactctgttgctcaggctggagtgcagtggtacgatctcggctcactgcaagctccacctcccgggttcacgccattctcctgcctcagcctcctgagtagctgggactacaggtgcccgccaccacacccggctaatttttttgtatttttagtagagacagggtttcaccatgttagccaggatggtctcgatctcctgacctcatgatccgcctgcctcagcctcccaaagggctaggattacaggcatgagccactgcgcccagcctatcctttttttttcaattttttttttttttttgtaatttggccttctagtcctttgtcccctcctcatcaccaccaccacctaccatggggagttttgggtgcaggaacctaaatccccacaaaggttctatgttgggggtatgtaataacaaataagtcaatcagatcaaatattattttcccaccaacttggaatttgctaagccccatgaaaatgtggttcaccagttttgaaaaacgtttggccactatctcttcaactgttgcttctgatttgctctttctgtcttcttctaagattaattatacatatgttagacttcttgagtatatcatgcatatctcttacgctctttttattatttttctctctatgcattggttttgatattttctgttaaactacctccacatttgcaaaacctgtggtctgctgtgtttaatcagctgttaacccatcagctgaattttcacttcagctattatatttttcagttctagattgtctattagattcctttttatagatttcaatccattgttggtattttttatccttttacctgtttagttcatgtttttctgcatcttcttgagggtattaatcacagttatttacagtcttagtttgctaactataatttcttgattacatgtgagctgcttccatattctgcttttttctcttaattattagccatattttctcgtctctgtggtaaatttttaattttgccaaacaatgtgtatgagaggacaatagaggcttcggctaatgttattaatgatcagggagtttcttcttttctgttcagtagatgcaatgaggtattggtaaactcagtccaaccagaattttccattttagtaaaacacattagaacttggtttacttgtgtttctcaattgagacttttctgggcttttcatagagagccttgtgagtctctgttgccttagttccaaaaaaattgtgggagaaccagatataccctccagagattcacagcccagctctcaagtgatcagtctcatagagatgaaaaatctggcaaatgttttgatggaaaacaggttatgtgcttgaggcagggcttcttctagtagttttttttctttctttcttttaatctatcaatctttaacagcatcttggatagcctatgagtgtatgtacttgacaaacattgcctctttatggttcacagtagtttctaaaatacattcactttattggccattatcctttgaaagctgattttgtaatcttgataaagtggaagtggattttatagtcttgagaaagtggaaattaacaaggcagcttcatggataatgtatccttttcttctttctgaaaattatacatactattttatatatttatggggtacatgtgatattttgttgcattcatagaatgtgtaatgatcaagtcagagtatgtggagtatctgccatcttgagtatttaccatttttatacgttgggaatatttcaagttctctcttgtaactactttgaaatagacaatacactgttgcttactatagtcaccctaccttgctctccaatagaacatatgctttctatctaactgtatgtttttacccattgaccaagctctctttatccccgtcttttacccacacagccttcccagcctctactatctattattcttctctctaccttcatgggattaactttttaagctcctatacagaataagaacatgcaaaatttgtctttctgtgtctgccttgttccacttaatgtaatgacttccagttccattcatgttgctgcaaatgacataaaatcattactttttaatggctgaatagaaggtttttgatatgtaataacttaaagcttcatgagattttactctgccatttccaaagcttccacatccatttccagttacctacactatcccagaactcaggaaatccctattttgcaaactcatcatttgtttgagacccccctcaagcttctgattgtcagagtagccccacataaccattaaaagctttgctgctttctctttttccagcagaggtcctctgtgtgggtcaagccaagtcttcagcttgcagccaaaattggtaatgttggcagaggggcgggaggctggcaatcatcaattctcatcttaatcattgtcattgtctcttctctgaaaattttgtttttccgctcctagtcgttttcttagctctttgattcttaaaaaaaatacagcttcttcaatttatccatgtttgtccaatcattgtagcattatccagaatatcctttatcaattaaatcctcccaggaagcagaaggtcttgaaactcttattttgatattcatttcctgaccaactatagaaatctatgtttcttaagtgctctttaaaccaattctttttgggatttttccctattcatttcctcattaatgagctaaataacactcgggcctgttctaaacgtaacattgaaaattttgcacgcctcatataaactccgagaacagggcaaaggggagcatgtttatgacactaattcttctagcagtgaactcttgctgaaaaggtctggaatttactggcaaaacagggatggtgggagggcagcaagagaagaaaggatgggggtggagccgtgtccaaaggaagatgcttttccgctctctagttccatgactatgattttttttttcagccagagtaagtgcatcttgtctatagaggtttactcaggattgaatgaaatttcgccaagatgtacttagagaagaaaactcagaggccagaaagagagattgctctatacctaaaccaaaactacatatagacatctccaagaccttgagacttgaaggtgctgattagcagttttggaataagtgggtgattattaacttgtttccacttttgttcattaagaattgataagaaaataatagttgccttagtggaattgcctgttattcaagtaactcacgtagaacgtttctgaggatttaagttcctatggccaaaactccccaaggtagttagtggttgaagttggtgaaggagaaaaaaaaggggtggagaatcaaatgaagagcagtcattttaagggacagaaaagaaaatgtcatcaatctagcttatgttattgagaaagctagcaaaagtcctttccggaaaacccttgtgagtcttcatttctttggggtattttgaagtagaatgtctagattagataacaggtatatgtttaacttttggggaaaatgtaaatttgtttcccaaagcagctgtaccattttacattccctccagcagtatttgagttccagttcatccacatcctcccttgcacttggaatggttcaaactttccataatagccatcctaagaggtatatagtggtaccgcattctggattaatttgcatttccccaaggactagtgatattgagcattttttcgtgtgcttatttgccatccatatatatcttccttggtgaaggatctgtttatatttcttgcccatttttcaattggcttatttattttcttgtattgctttttaagagttctttacatattctggatgcaagtccagtggtgtcagccgccccactccccagcacctggtctggccctacctgcagtgggacctccgcgtgaccctggtccccacctcctctgagtgtccgaggagacacgcgcggggcagcaggctcccggcagctgcagtggggcatccccgcgggaccagtcctcctgcagcagtgtggggtccagccacgcccggttccagaacctgcctccgtcctgagcttcacctgcagcagaaatacaccatgatctgccctggggaaaacaaaacaaaacaaaaccaaccaaccaaccaaccacacatataaaactttaataggaagtggaatagaagtgactacaaaatactaccattcaatttcatcatgcaagtactttaatattttcactcactggcaaaataaagcacatgtaactctaaatgtgaaataattctgagtctttgactaagtcttctaaagaaagaataaaatgctggtgaaaacgtgaaattgtgtagtgagggatttatgaccttgtttattatttttctacagatgttaagatgatcatgattaataccaattgaagcatttacagaatgctatttaggcccaatagtgatgttaaattacagtatcagagaacctgatagatatggggtctgattataaagaaactttattcaaaatcatctttgtcaaagttttaacacagaagcaaaagtcaaatatgttcctacatgagatacaagctattcttgctaacagtacaaattctgtcctgtaagtattagtattttcaggttttttcttttctatgaaacggttgaaaggaaaactttagtacgctataactcataggctactttgtgtatttatcattttataaacaaatgtcttgacaattaagttgtgtatgaaggccatcatcaagtcattaactcttatatcaaaacctattattattcactgatttagataattcaatttatgtgtgcgttaccaggttgcagtcagccaacagacacagaacaggttaatagaaatatatatatttttcttatcaggttttcttttattggaacaggttgcatatatatacacacatatacacatatatgtgcatatatgtatgtatatttccattgatataatattctagaaaatgcagactaatcactagtaacagaaaagcagatcagtcatggcctggggaggggcaagagtgacgaattacaaaggggcgtgagaaaaattttaggatggtggacatattcactattttggtggtggtgatggtttcatgggcttatacatatgacaatacttaacagatacgccacttcacagctgtttcctaagagtttaacctttcagctttaggcccctcccccaacacggtgtcctttctcattgccacatcataaaccagtctttcccctgagtcacacacatgcaatccttgcacagcaagtcatgatggtgccctgtgtgtatgtgatagtgatgggaaaaggataaaacaaaacactcaacttgtgttatggcaaaaagagattgcagtgatgataaagaatgcaggaaaggaagccaatttatctgttaggaaaaaacttccacttgcttataaattctgtttcctctgatgaagtttcattataaagtgttttctttttctttaaaaacaagaagatgagaggacattgattacttaaaaatttttacattaaagaatactggaaaatttcagagaataaatgtaatgtataaggcccatataaggccttaggttgaaaacaacatgcacccatgaacttgctaagtaatttgagaaatagaacataattggcatctttgaagttttctgtatacctctctttctacctccctgcttccccccagaaatagctgctcttctgaacgtcagtgtttctgtagtgttagcatttatgtttgcatataaaaaatacattattttacttcatttaaagatttttaggccgggcacggtggctcacgcctgaaatcccagcactttgggaggccgaggcgggcggatcatgaggttaggagatcgagaccatcctggccaacatggtgaaaccccatctctactaaaaatagaaaaattagctgggtgtggtggtacgtgcctgtaatcccagctactcgggaggccgagggaggagaatcacttgaacccgggaggcggagcttgcagtgagccgagatcgtgccactgcactccagcctggcgatatagccagactctgtctcaaaaaaaaagaaaaaattttataaaaataatgcactattcttccttttttcattttacgttttgtttttaagctgtattcctgtcaatatatgtagcacaacttagttttcacactgtgtcctattcagcgtgtaaatatactgtaattgacgcattcattttccactcaatgaatttggggacttttacaggattttttgctattatgaaaaatgtttctctgagtgttcctctactcgcctcatagggtgtgtactcatgatattctttagacaaagtttaagctgaaccttcagataggcacgtgttcaaactgttttccaaagtggttgcagtgatttatatcacatcaaacagagtttctacttgttgccaacatctggtttgttagactctgaaagttgtttgcctacctcggaaatgtgaaatagtttctcatttgtgtttctaatttccttgggtttttaagttaggtatcttttcatttagtttattggcctttcaggttttctattctgtaaaatgcctgtttttgtctttttttgcctatttaatatttttttttctcttcctaactgattctaggcattctacatgtttgtgttactaactctttataagttatttgtgttataaatgtcttcctcttctggcttgtcttttatttttttaaatgatgtcttttggtgagtggaagtttttaataataatgtaggcaaatatattaatctttatatattttaaagcctttgagtctttttaaaacttttaattttaccatcctgacattctcttagataaatatattcttttgtattttattcttaaagatgggagattttgccttagtatgagattcatctgaagtggatcttttttttttttttttctgcatgggatgaaataaggaaccaattctgtttcctcagcatatgctttgcctgttgtcccagaagctgttattgaacaacgtgcattgccacctctgtcatgtactaactttccataagtatttgtcaggataggaaatattacaatgaagttgcaaagcttgaaatctcagtgacttagcacaacaaaagtttacgtctcacagttgttaagtctaaagttggtcattggctctttttcgtggttcttttagaatggtgactttatcggggatcggggctgcttccttcctgcaaccctacaagctaggaattattttctttcatagcttcacatataagagaaagatagggatgatggaaactcacatgagctcttaactgccctggactagtggcttggtcccaaccataaacaagggagggtgtcaaatttggggagcatatatacatatttaatgaacattaattgtctgtaccatatcatctaagtgtggacctctttctgtttcctctattctgttcctggtctatttgtatatccttgcaataatctcttaattgctaaagctttgtaataagttttgatatctgcttgtacaagtccctcatctagaaatattgatgaaagaaaaaagactataaaatattaggaatgaacagggatgtataactatggacatggcaatatttaaagataagagaataccaagagtgactttaagccaaaacatttgaaattttagataaaaaaacaaattccaagaaaaacataatgtatcaaaattgactaaagaaaaaataaaaaaatctgaatagtctcatataatattaaatatttgattcatattataactatcctacaaagaatagtttgtataaagaaaatagtatagtttctacaaagaaaatgttttacctaaatgatatttgagtgagttctaccaaatattcaagcaatagataatgtcaatcttatacaaaatttttagaggataaaaattaaaagaaacacattctaatatattatatgaagctggaataccattgacaccaaaactagaaaatcccagtataagaaaataaaatcatatttcaacttagaggcacaaatcttaaaatgaaataaaattatcagtgtataacccgtggagattttaaaaagatgagaatccatgaccgtgttacgattataccagaaatataaagatggcttaatctcaggcaatctattaatattatatatcatatatagagtaagggaaaaactgttattaatagatgcaaaaatagtttttcataatatccaatatctattcttgatactctcttgggaaaccaggaagagaggaggtcattcttaacctgataaatgatgtctactaaaaacctagaagtaaatcttgtactctataaaacactggttctctttaaatcaggagcaatacaagaattactattatgaattagtttatttaatgttttgctggagttgctggccaatgcagcaagataagaaaataacaaaagtaaaaagcactgtaataaaatgaacagagctattattatttgaagataatatgacctgtccacatggtaaaccaacaaaaaatgcttgctttttactgttgagaagctgggtcatattcgacagtcaagaattctggaataagttgtgtttcatcaaatccctatttaattgcatagtacactgcagtgaaagtatgattatgaaagccatataatagcataaaaactatttgttaagtcaaaagagattacaaagatgtatgtacataggaaaaaaaagagtaggtgggaatgttgcttaatgctaaagggggttaggtggcaagatcatgaattaattttccatctattctttatgtcccatatcttctgtgctgtggctatattgtttacaacaaaagtatttttaaaatttgtactaatgagaacctttggaatcttcctgcagatttagtgatgcttgttgatttgtatcagagagctgttgaagacaatacagtttcacctaacgtttaactgcacaataagtcagatgcatttattgggttgtgactcatacttagaacctgacatataatgaataccagtaagacatcatcttaccttattaaacacaataacttccttattcactaaaataactaaaaaaggcaccgcgcccaaagttcacagaaatatacatcgaggcattgtgatagagtaaaagagaagaaaaaggagttaaacaaagtctgtagatccaaatcctagtcttggttttcccatagtaggcttggtttcctatttcaaaatgtgaatagtgagaaactgccctgtttataacattgatttgtcatgagggcaaaacaaagaacccaaaattagagggcctagaagagatggtagaagcagtttccattggatgttcgtacccatccagtggcctttgtttgagttcttccagggatggggcaaacactgtctctgcattgctgagtgcttaatctattgttatgaagatctttttcacattggcctcctggacgtctatcccatggccttcgttccatctctgggttagggtaccatggctcctagcatggtctggtggctaccaggtgtacagatatcaatcctcttagtctaagggcctgtgggagagcctagctggtcttcttcggccatgaacagcctttgttattgttttctctgcatgccatgacaagagcgtgtctgagggcattctccagtgatgacctcctttgtatcagaaggtacacttccaccagggcaactacagcctcctaccacacatcattcactgtggacgtcttagtcagtcaagactctggcatttgtttggttttgttttccaccagtgctttgctttttcatatgccctgtcctgtacttaacaatatgaggttagggaactaagaatgggattttagatttgtctgtgttaagtctcactatgttagatttggcctatggttctatcttaatggcgtcttttgggaccctgatttgctctctcagtgaattcacagttcattttaactccaggactcccagaatgtggtaagcttgcctgctctgcccttctgctgtagaaacctgttctgcacctcccagctccctccccaacccctggcttggcctcgaggcattctcctttcctgcattcaaggcctccaggaatattaccacacaccatctgcacatcgtcgggttcttttggccaatgccaatttgataaatttttttggcttcagtgtccagttctgctttctaaacttgtatttgcttcctttggaaaatgtattccttctttctaccctccctcctttcctgcattcctctgctctgtactctccacaattgaagagtgccatgaccatgtccatgcccagcctggctgcctcttttctgggaggagaggtcagctccacacctgagagccaggatggaaccaaatacctggaactgagcctgaggctttccagtagagcatactcttctaattgactcatttaccattgagtatgggtgtttatacatgtatccaactctactaaccatattctttgttttgctcacaagacagatgtttgcagatacttacatgaaattctgattcactaagttcacagcatttaactgtggtaatctcaccatctaacaacctcatcaaacaaaagattgcatgagcttcaccagacctggcctgtttttagtcatttcatgctttctcttggtgatcgtggcttccttaagtgctgaaagactatccctgtaatcattcatctagaatctttcccattccttcatctgtgcttgcaaaatcccttaaactcagtaatgggtgtggaagctgtctgtctggaggtatgaagaattaagggatggcattctccccggaggtttgatagaaagctggacacagtgcggtctggaagagtcatggggatgatacgaattgttcatgtatcattgcctggaataggagtatgataagcagccaggcactcaagtcagatccttagggcctgaccacaaaggttaccagtggccatcggggatggcatggttaattctctagtgtaaagagacaaaggttaaactaacagaatgtgtcacactggaaagcattttggagatcaggtcaattagcactccctgtgttactgtccacacaagtcacccagaaagcttagtcaaatatagatttgaattcagtggttctggggtgggccctaatgttctgcatttccatcgtgctccttggtgatgctcttggcttatgggccacactttgtgtcccaagagtttagactatactgttttgttttgttttttcagatgtagaaactgagatccagtgagatgaagtgattttcccaaagatacatagatgaagttgaagcttagctctttaacccaggtctgctggcgtccaggttggtgtctctctaattatagaattgctggacttaggaaagcagaagtctcctgccctctcttaatgacccatagcatgttgagggggagccaaggttagattctagggttgcacatacttgcacaaacatgcacacacatacacacatgctcatgcacacacatgcacacacatactgtacgtgcttcttcctattctcctttttcaattgggaggtataagaaacacatggattacagccacattaaagatattcataaatgcaaatcaattctgaatgtgtaaacttttccataagaatattctgggaaaatacttgagttatttctgaccttttatgtataaacacagacattctggagtttgtcaaagaccatgttactgataaaattgtgttagaatgacgtcttctgatagtttaaatgttaaaagctctgggctcggctcagggaattctatactttagcattcataaaggaccctagagtttgagagattatccattaacttctgatattgaatttttgttgccaactatgactatttgttttccctgaactctgtaggggaacaacacagctgacaaaacccaggcaaaagcgtgtgtgtgggtgcgtgtgggtgcatgtgtgtggcgtgtgtgttcacacaggttaactaaacagtgcagattcctccaatttttctcctttttgagaagtaggaaggagcaagagagaagaaatcatctggagtggaaaagagggctggaaaagtccttgaactaataatctgccaattaatccagctgcttggaaatagcctggaattggaaggtcttttgggtgctctctggaaagggtaccaggaagtatgagacaatggctgctaggaacttgcactgttcctgagtagataagacctgttgtcaagtaaattgcggtggatccctggtaacacttgaagagcaatgcaagcctgggctccacctgggctctacccctgcctgactaagggagcttggggaaagtatttacataatctcaatcagttttctcacctgtaaaatgggcctaaagaatttaaatttccatgcaagtcaaaaccataatgagatatcatctcacaccagtcaaaatggctattactaaaaagtcaaaaaataagagatgccaacaaggttgcagtgaaaagggaatgcttatattctgcttgtgggaatgtaaattagttcagccactatgaaaagcagtttggtgattgctcaaagaacttaaaacacaactaccatttgactcagccatcccattgttgggtatattcccacaggaatattaatcattctaccataagacatgatgttcattacatcgctattctcaatagcaaagacatggaatcaacctaaatgttcatcagtggtagactggataaagaaaatgtggtacatgtacaccgcggaatattatgcagccatgaaaaagaacaagatcatgtcttttgcagcaacatggatacaactggaggccattcttctgagaactaacacagaaacagaaaatcaaatactgcatggtctcacttataagtgagaattaaacactgagttcatacggacacaaagaaaggaaaaacagacaccaggacctacttgaggatggagtgtgggaggagggtgaggattgaaactacctatagggtaccatacttattacctaggttacaaaaaaatctgtagaccaagccgcctgaatacacaatttgcctatataacagacctgcacaagtacccctgaaactaaaataaaattaaaaataaataagtaaatgaatatataatttaaatttccttgaagaatgcctggcacctgtaagtgctcacttctgctatctccgttatcatcacagagagaaggcacaggttcagagtcgggaaaatcaccccaggatgcttgagtggggtctgcttgagcaaatggcggtgaaaactggaaagaaggggaaggagcaaagaggaggtgggctgtgtcgtgctgagtggtgtcaattggctagggtaaggagtggcagtggcagaattgaggctgcagagcattgaagcagaggtttgagcagtgcctcttagggtcagcaggcggcccatccaggtgagcacaaagcgctcttggaaagggtagcgggaacaatgacaggaaagtgtgtgagaccagatgtctgaagaccttgaatgctagaattggaggcttgactcttcctccctacgatgcagatttttgagtagcgttgtgataggctggactctgtatcatgttgagaatgttcatcggagtgcagagcacaggaggagctatgagagaaataaaagaggcaggccaggtgcggtggctcatgcctgtaaccccagcactttgggaggccaagggggtggatcatctgagttcaggagtttgagaccagcctgaccatcatggtgaaaccccatctctactaaaattacaaaaattagccagacatggtggcgggcatctataatcccagctactcgggctgaggcacgagaatcacttgaacctgggaagcaggggttgctgtgagccgagattgtgacattgcactccagcctgggagacagagcaagactgtctcagaaaaaaaaaaaaaaaaaaaaaagaggaggcttggcagcaccagctctcctaggtggatctggctgcatttgtggaagccagaggctccagctttcatctccctgagctgaggggtgatcagtggccatcccacctccagggtgtggtgaagggagacttccagagttctcagggcacatggcaggagtggtggccaccatgagaagtgggccagcatctgggacacgagcagacctgaataaagagtcctgcagcattgcctgggctgactctagggagattgctctaaggattgggaggtaggcagagagggaaagcttaggccaccacaggcctgagactgaccagtcaagactctgatgatgggaacatgataatgagctggattcagccagcaggcttgtccaggttcaacacaaagtcatgagaggaaagcaccagcttcgggaaactttagaggttaccgtgcagtggcgggtgttggtgtttcttaagggtctggcacgtttgctgagtgattctggctgtctgcctggctctgagcttcctgttcatagttccccagatgtgtcacggccgagggattaaagccctaagaggctgtgacacagccatctccaaaaccccactttctccttcctttgagcctccgtaccagctggggcgtccggcaagatgtgagttgtcactctgctgcggcacagacctgaattaacaactctagctagggctgacttcaaaaagcactttcgttttttaataaccaacatcagctcagcaggcttcatttgggaaaagaaaccttgtcggattaccccgacattctccacctcctgggaggccagccattcccaaatgccccaaggatgaagaacggagacggtaagatgattaattgcactgcaggttttttgtttctgtatttttttccctcctttttttgggtttacttacacattaatgaggtatttaggaaagacaaatggaatctgataaaaggtaacgttatattgtttgtcgaaacaacattttaaggatttcttgaagttatatggctctgtaggcatgtttcactttaagatgtgtttctgagtcatattaggagaacgactgtgattatctatggaagattaactatgaaacatatgggaaatatactttataactgtatattacttataaaccatgaatagttacatgacttttggtatgtggtgagagatgttaagtgaaaggtgttgtaaatgaagtcgttttataagactgttgttactgtaagaattgagacttattttatcacttcccattaagcttctacagtgttagagaggcataacccaatgttgactgaaggtgctatgttttctttttaatttattttttattttgtttgagatggggtctcactttgtcacccagactggagtacaatggcatgatcttggctcactgcaacctccgcctcccaggttcaagcgattctcctgcctcagcctcccgagtagctgggactataggcgcctgccaccatgccctgctaactttttgtatttttagtagagatgggttttcactgtgttagccaggatggtctcgatctcctgacctcgtgatccacctgcctgggcctcccaaagtgctgggattacaggcatgagccaccacgcctggcctgaatgtgctatgttattaatggcagcctctattggtttcatttaaaggtataatgcattgtattggcaaaacttgtacacgctttcttcaataaggacctcaaaggtaatcttaaaagcctgatcatatttttctccccccttcagaagctttgccaatgttgcacctatagctatagagaagaccatgcactctcagaggggattataaacattgccttgcatttttatccttgatctccataatttatccttgatctccatttatccttgatcctcataattcctactgatagtgttgttgtgcataagaatgagaaaatgggactgaacctgaaagattaaggaaagaaaataacaaaacaaaaaggaaaacctaatgaagcttatcattcaattcaatttataactccttattgctcatgcaaaatgtgaatttttcgctgtgttggtgagggtgtgaggagtggatggtggggaaggatgcttcaaaaaatacagctaaggaccaactggtttggtgagtcatggcattcacccatgagacagctggagaacagtgacgtgtgtgtctctgtgtgtgtgtgtctgtgtgtgtgtgcatttgatgccagagattggtgtttactataaatgtgttgatctgttaggaaaaggaagaagacaaagttgtccagaaagagccaagaaaacttcttgagatgaatttgatctgcctaatggtagtgatgagtttaaaaagattcttatggcctttcctaacactacatgctattgttaatcattgaactgacaaaccccgttgagcacaagactgttagtttacttaggaggaaaacttggcaggaacggtcaaagaatagcgagggtatacttctaaaatacgtccttggaacatttacacaaacagcacaagctcattgtcaagaataaaattttaaaaaatacatagagataatagtaaaagacgagaagtaaaaacacaccactgtgaggtaaacactgttaacattttggtaggtgtatttgtctctgagtacatttacattttgaagaaatatatttgtactctacatgcttttcggttatctgcttttacctcacagcgatggagcatcttgttatgagaatgagttttcttttacaaaagcttttccatttcattgcatagatagtttattaaatcctgttggcaggtagttgattgtttttctcttattaacagtactacaactatgttcttctcttattaacagtactacaactaacacccttgtagctaaacctttgcatctccttgatgcaaaggttatctcaacgagttttccttgagataaatccccagaggtagaatggtaggggtcaaagggcatgggcattttaaaaactctagatccctgctgctaaattaatcctaggaaagtttaattaatttatgtgcccaccagcactgtatgaacattttccaactctctcatcagcattgggttttataattttttgaaaagtgtgctactctgcatgcacacgtatgtttattgtggcactattcacaatagcaaagacttggaaccaacccaaatgtccatcagtgatagactggattaagaaaatgtggcacatatacaccatggaatactatgcagccatgaaaaaggatgagttcatgtcctttgtagggacatggatgaagctggaaaccatcatcctgagcaaactatcacaaggacagaaaaccaaacgccgcatattctcactcgtaggtgggaattgaacaatgagaacacttggacacagggtggggaacatcacacaccggggcctgttgtggggtgggaggaggggggagggataacattaggagacatacctaatgtaaatgacaagttaacaggtgcagcacaccaacatggcacatgtatacatatgtaacaaacctgcatgttgtgcacatgtaccctagaacttaaagtatcacaataaataaaagaaaagtgtgctactctgataataggcaaaggtatattttgttgtcttaatttaccttaaggaaaccctttgcaaaatctgctggtttccagttctgcccctttgggttcagcctctcgtcttttttggttactcattgccaaagcagtcacctcttacagtaacttctgccaacctaatttctgaggactttgacctcttttgatgtctctcagaaagtctgctgagagagcgagagaactggatgcttttgctctgaatttttaccgattgagtaacctggggtaaacctcagtctttgtgattttgtctcctttttagctataaaatttagacagaaggcctgtgctagccacctcacaagattgtactgggaatataaagaggcaagatagaggcaagctttttgaatagaggaaaagcaaaaatgcaaaatggtattattattattgttgttactctaaagtttagtgataaatctaaccttctaaaatatatagtttctggagagctgcatgctgaaattttgtcgtcttctaattctaaacttgggaagtgtgtgtgtgtgtgtatgtatgtgtgtgtgtgtgggggggggtgtgtataacatatttctatgcttcttggttcttagattcagtagcagtgtttagtgtgttacagcagtgcatggatacattttagattaaaaagatttccattttgttgcttatttattccattcttgtacaggaaaaccagccatcctcctcctattgcattctcatcatccatgggctttgctcagctccccagtggactgagagctcctcaaagacggggtccggtttcatgtgtatacctctctccagggcctgctttggggtctgacacccagagggcggatcaatcaatgtttctcaaatgagtcaatgtaagggaggtagaaaaatatttacccagttctgtggagaaaagaatattccaaaaaggcaccccagaagattaaaaaaaaacctaaatggagcttttctaggggcaactggttatttatttcgtttagtttgggtgagtctcagtttctattgagtaaatatttaaagctctgaaaggatattaaacaaatgaatgcaagccaaggataggaccaggaaaatggagaaccctgtctttataggtgcaagtgtcatggatttggcatgaatatcaaaaactttaaggaggcatcgattttcactctgactcccagctcagtgctgggctgcaaaaatcaggaccaaactgacatttagtaatggtttgaacttggtactgaataataataataataataataataataataataataataataaaagctaatatgtaatacagcacttgctaggtaggagacctggttttaggtaccgctcatataaaataatcagtactattattttattttgcagattaagaaacggaagcacagagagtgatttgctagggttataccagtagttattgcagagctggaattatgacgcagacaggctcactctggagcctgtgggtcagtgagggtaggtcggactgaactttggagacaatgtctcatggttttaggccactggtgatgtttgtgctgtttatttgggtatatgactaccatttattgagtcacctactaaaggaacatgcactcttctgggttctttaagtataatatcttgaatctttctcgcaaccttgaaacattattccaactctaggtccagacaagctgagaccctgagaagttcagtaagtttcccaaagctgcaggctagtgaggagagatccatcagcctgcaccaagtctgtctgccttctgagtccatgtgccacactggcctggacaactgagtgctgatgtatttggttcttccatccaaaggtgccaagagtccagttctactgcatttggaggtgttgaacctggaaaactcagccacaacaacccctcaacttggggatcaggcagggctcagcctcagcttctctgaacccacatgggccaatgtgaaatggatttgatttttcagaccagatcctccctggcaggaccatccaatttatcacaccaacctagactcgatgggcgtttaaaatattgagagatatttccttatatttcctctctattgaccccccaaatctgcaccaaggaactccagcgaatgagatggagtatggtgagtgctagcttgggggccaagggcggcttcgtttctcctgggcgacttatctcccttttctttgtttagtgtttccagttataacatgagggaaaagactataatttaaaatggaattttactttttttggttaaacttttccatatgattttgaaactctttaaatttttttgagtgaatgacacatggtttatttgcttttggagtggtaacacaatttaaaaggtgaaagtctttttctcttccctttctgcagacgcttctttccctcttcctcaccaataggcgagtcttgttaatagtttctagttttttcttccacctcttttgcactcatagtgtgcaccattctataccttgatccatagctgtatcaaaggcggtgcattttctgcctcttaatggacagttggattgtttgcaatgttttgttatttcaggcaatgttgcgaccagtggcagcctgccctcgtaattttgcagaagtgtttccaagttgttggttaaattcctggaagcagaattgtggggtcagaggctgtgtacacttgtgattttgatatatatttcagaattacccacccccccaccccaccaggtcataccaattaacacccctaccaggaatgtttgaaagaatgcctctccatgtgctcgtcaacagtgcctgctaacaagctggtttttattagacttcggcagtctcaaaggagaaagctgcaaacttagtaagttttctaaattttcctatctcgtatcatgaccatgcagtgtcagccccactgtggtctctcgtggcaaatacaacagtctgacaggtactttgttgactcaggttgggcatctattcaattggcttaaaaccatttgcgatcacaacgtttttcatttggtgattgtgttttgaggccttgctgtgtgtccagtcatgggatggcacagggatgcgtggaccctgccagggttgcatgaaacagctaggcagccgcgggagttggcacatgtgtgctgagcactgtgaaagaaacacagagacagaaggctgcagagacagcgagtagggagccacggtccgtgttagcctggtgattgggacggctcgaggtggagtgatgaagtctgaggcatgagaaggagccagccagacagagggcagaggaagcagagcataaaaacccagcatgagaagcagaaagcagctctatgtatggccaatgaagagagtggaagggaggccaaggtgagctggagacagaggcagaggccagagcatggtgggtgtttagggctgtggcaaggagtttggcttttattgtgagtttcaggttgactgtagtcatgggctggggaagatggtgccaaggtctgtaaactcttaccttgtagatgtaaattctcacctgaataacaccagggaggcatggttctatacacaagcacctgtcagactgtgttgtatttgccacaagagatcacagtggggccgctgctgcacatagggctggcgaccagaacactgtatctcttggccaaccttgtcctccgtgtgagacaagtggagacattttacaaaaatacgttctacgtctctctggagtacaactcagtttacaaagggctttctcattcattatctcatgcattaataaactgactgataattttgacagattattattgcatgtccaacctgtgctaagccctgtgctaggtgctggggatgatgagaggaagaaggagtggaaggggaaatagaaagatgaagaaaattcagagcagcttacagtccatctgcgagatagaatcaaatgtcaacaatgagaaggagagcaggaaggggacagtgaagaggacccggccacctctaggttctggaccagaacacgggtaactctgccccaggggcctgcttggtgccagggagtccttcagggatggggtctcaggagacagctgcaagtagggcttctctgacatccttttctccaggtgtaagtagggttatctttctaactttagaaagatagaggtgaccaactgagagctttcctcagggcttctgagtgggcaaagggcagaactggaacttttcctcccacccctgaaatctgaggccatggctctctgtgctcagaatagaacaaaattcctgaagcccaaccacctggggaaggcattgaggagagtgtctctattatgcatcgtctttcatgctggccaccctggttccatgatgatgaggctgctttgtttatgagtctgtagtgttttcagggctctggagaaggggtgggctctctaccagtcttagggtcttggtggctctaagcccagaggtgcttccattgtgtgaagaaacacaggagaccgagacaaaatattgttgatcagacactcaggcctatttcggcggcaaaactgtcctaagtggtcatttatggccagcacagagtggggattaacgtgtgtgtgtgtgtgtgtgtgtgtgtgagtgtgagtgtgtgtgttgtgggaggtgtttgggggaggtctcaggaattgctggccctgaggtgatactaatggatcaggtttccatggacacaggaacatctgggcaggaagtaggaagactgcaaagtcagctcacccccttcagtgagcttcacctcccagtccagggaaaggagggcagggcttgcttctgagaagggactcctggtgaattccaggtactcaacacagaattgccccaatcaggtgtaacatgggatgggggttgtcaaggcctaatgccaggtaaaagaggaagcaaaaggtgtgtttaccatagaaaagtctagaaatgtagtcataaaacttgaaatgtgtctgtgttaagtgtaatggaaataaatactttaatagttttttttaggcgttgggttttcctttgtctgtgtacatagattgaatgtctgtgtgtcccccaagcccaccactaaattcctatgttgaaaccctaattccagtgatggtgttaggaggtggcatgcttgggagattgttaggtcatgagggtggagccctgataaatgggattagtgcccctgtaagaagaggccagagaactagctagctctctttctaccatgtgaggatacaatgagaagtcagctgtctgcaaaccagaaagtgggccctcaccagacaccggatctgtcagaaccgtgatcttacacttccagcctccagaactgtgagacacaaatatttgttgtttaagccacccaatctatgataatttgttacagcagcccaggctaagacactgcgttcaatcagcctgtgacaatggtataactatctttaaagactttcagtaaggattttagtaagtttcaggtctatttcctgaactaatgaacaagtgaatgagccattgctatagaataggctcaaagcacatttgtgtcttttgtggaaatttgccttcttttatcctttggtgagaaattattagcggtgaatgtacttgtaagttatccatcttttctccgaaagtgctgaacgtcttaaccatgagtctcttcttgtctgagggaggcggtgttgcttttggtgaccagagctgctcagtcatgtataccaataacatattccaacatgggtcacaaaaccaaagcattccaaagccatgattgtgccccctgaatattgatgtggcttccctcattctattcctggagttagtgagagggtagaacttgactggaaatcctggaacaattttttgggacttttcattacttgcgattttatttgctgtctccttgatcttgcttgccccgctctaggctgattagcagccagtctcggaggctgcaccaatgacgctcggcctccttgccctggagcctgggtacccacctcatctgctattctagaaccggccaggatcagcagccatccatctcctccccatgatgtctgggagcttttcacattgcctctgttccttacacaggctttatgatttttgatttgtctctaaggaaactgaggcttaaaaatagcaggtgagtttcttcaagtcgcggcagatcgataacagagtcagaatttgaacatgggtctgttggattctctcagctctgtacacatcattatgccaaaatagtaaggaacatgaggaagggaaacactagtttatggaagagctctttctcacatgtccttcaggcagtcatatttgggcactggtttttgagtccattcatatcaagcatgccattcaggctctcttctgccacttctaagagttatccaaattggtgcatggtacccataaactagtttttaaaagagatatgattactgaaatgatcagtatgtaatattgaagcccaaatcaatacaaatgaaatgcatatcataataaagtacaaattcaagtaaagtagggacttggtagatgtttctctggaaaggttaaacacactgcgtggaatgcatggggaaacctggtttcacaaatagtatcagctgtctgctaaagaatctgtaaaaccacatgcgaaggttcacaggggttctttcctgtagggaaaatatgtgattattgtcaacagtgaaggaatgtgtactggaacttaattgatttaaaaagtctcatgtgaacctgccatgacaacctctttgaataagtttccctcaaggtttaagcatttctcgagattaacgtagtgggtttctgggctgactcacagggagaaggggaggttacatttttgctattgtgataatgtgggaaattacactcggtatcactcactgtgcttgaatctttatcatcaacctcaaactctgggatttatgtaaccgcaagatcagaactctaagcttctttttttctccagttgaaatttattttaagttggtaaggaaatatgacatatatctatagaacctaggctcataggaaggtaaaaaatgctttggattggaagtagaggcagacctttactttagtctggaactgatgtcctgattgtaaattgttgttctagggaaacccagtgtgtgtgaatgtaagcccctggagttgagttccctttcttggctgggccccagtctgccacgtcagtgctgaaaatggacattgctgctgcctcggtgacatacaaataggggaaatgtctcctgaatggaattactctttgtcatctaggccagtagttgtcaaccctggctgcatattggaatcacctgggagccttttaaacactgatgcctggatcctaactccagaagttctgatgtgatgggaatgcatgcagcctggctttttaaagtcctcaggtgatcatactgtgcagttagtgtaatgtgggttgagaaccactgacccgagaagtagacagttgccgagtcagtaaattacccaagtaaacaagaagctggttagaccaagcctgtccatagtgattgccaaatcctgcctggtggggaaatttaggaccatttcctcagaaaactttgttactggaagttatcaagggctctctacctagtaagtgtgctttcagttttttaaggcactgtggatataagttgtgtaaacgtagccactttcatttatttggcaaatatttaaacatctgctctgttcaagttatactcaatctcagcctacttttaagcttattaactgaacagcaggggagagaactcaagcaatgcaaagtaggggctgcaaagtgccatcagagagggggagatgaaaaacctcaaggtttcagagcagggagagatagttgcctgtttctcctggtcggagggatgggaaaaccctaaagaagtggtgcagtatttgggataggccttggaggggggagaaggcggaagaagaagacttgagctggaggagaaagaagggttgtattctgggtagaggaaactgcacgagcaagaaaagaggtagacattagggaaacttgcaaggaaatgggcacatagtaaacatgggtacatcaagggcgaggagaggaacacattccaaaaggtaggatcaagggagactgaggagcatctggaatgctatactgagtggtctgggctttgtttgggaggcagtggagccttgcatggcaggttttgacatccaaccttgcagcaaacggcaaataggagcttgctcagcagtatttatatggcgaatctggattatttagaaggaaattgtgtttctgtctcactgtgtggcccatgtaggttgcatagttgcagtatcttcaactttgcattgacaaggtgggtgcgttgcactgggtcgagatggttcagatgtcccccaatgcattgctgctttcgacatctctccatttctctagcttctaacactttgtttgtctctcttcaaccaccatgctgagaaaaaagtttaagggcttttcttgttcccccacgtaatcttggcaagtaataacagtgaaccctggagatggaaagaagtgtggatgttaggagactggattgctagcatggcattaacaatttttggctatgttgactctcaagtaaatatggcaactgcttttgcttttccttttcaaaatacaaagataaaatttaaggggaagtgagattttggcataaatggctgactcttctgcaaatagcatttctggattaattttattacatccaattgctcttccatgtattccgataattttatttgtaataaagttcataagtgctgttggtgattagccaaaaaaaagagtaaagggaggtcaacttttgtgtagttgagatcactttttctaagtctgattttaaattgggtggtttgtactgtgttagcaatgttagaggatacaaacaaccataacaacaaaacagcaacagcagcaggaaggtcatccacccgtgctgaaaacctccttcctcttgggttcacttttccttctagtgggggaaatggtgaaatcacgttagcactttctactcttggtcctggtgtcttctttatgacctcgtaacattttcctagataaaatttgcatgtctctaacttctgagttccacttcttactgttctcatgttcattcattattccattgtgacgtgtttggctgagtttgaaagactctaatgataagtggagaaggaaaaaatgacttttataataaaaggtaacacttaatgacatgaatctgagacacatgactaagtaagaaaataaaatattgacgtcttggttttaaatattgggcaacaccatctcatgtttatcctttttctcatcaaaccgcatgtccaattttggattaggaagacattcttactgtacttatggtacgcctgcaatcatggtgcctcctctgtctatttttgggttgaccaaataacaacgcaaagcactgagtgccaaccaccacaacaaggacttggtctgtatttgtccatatgcttgcacttcccccaaggtggacactgtcatccccatgaatggatgagggaagagaagctgacagaacacagctggaaagagcagggtgagaggtcactgtgggcctctcccatcagtgatttggtgctatttgtggcctctgcaggcatggacatatcctgttgacattacaaaataaaatggatgcaaatattattgtttagtgtcttccaatttcttggatccttaaatagctgccaacatcgctcttcagttatttatgtacacaaagagctatttctgaatatccgtcctaattttcttctggcctgttccctgcatattaatgtattccaatgaatcccacccattccaaagagaactgaagcaagcttgtggcttgtttagatgtggtccaagtctgtgtggtcccctcagggaggtgtagtaaggatttctcagaaccggtgtttgcgtgtgagggaagcctgctgagcagagagcgtttacattgcccagtgttccgagtgcttgagtttcaatagttaccttagtttattaggaccttggaagagtaccaaagctgtgagttcctgggagttttccgtcaaaatcagtcctctggcatggtaaagaatatgtttgtaaaggaacaagaaaaaaatatataatttttctaaatatatatataggaaatgtatatatatatacacatataatatatatatagacaaaataaaaatatatatttgatctctggccctgattcccagcacagagctcctaacttcttggaatttcctgggtgatgggagtcttttgttctaatgaagctcctgggaggagaatggtcactagaaagaacagattagaagcttgggaatttcagtcctacccccatcctctgggaagacctggaggctggagattgagttaatgatcagtgatgttcaagtaacaaagtcttgtaagaatcccagaactctggggtttggggagctccagggctgctgaacatgtggagggtagcccacccggagagggcaaggaagcgcacttcccctcccatacacctcgccctgcatatctcttcatctggctgtcttctgtatcctttattgtattctttattacatagtaagctgggaaatgtgtttccctgaggtctgtgagccatcccagcaaattatgaaatccaaggatggggtcgtaggaaccctggtttacagctggtcagtcagacatataggtgacaacttggcacttgtatttggtatctgaaatggggggcagtcttgtgggactgaacccttaacctgaggtctgtgctaactccagttagtatcagaattgaattgaattgtgggacactcggctggtgtcattcagctggtgtcagagtattccttgacatcgcttcaatccctggtcacagaagtgtgtggagtgcaggtatagaaaaggaaaagtagggccgggtgtggtggctcacgcctgtaatcccagcactttgggaggccaaggtgggaggatcatgaggtcaggagatcaagaccatcccggctaacatggtgaaaccctgtctctactaaaaataggaaaaaattagccaggcgtggtggcaggcacctgtagtcccagctactcgggaggctgaggcaggagaatggtatgaacctgggaagcagagcttgcggtgagccgagatcgctccactgctctccagcttgggcaacacagtgagactgtgtctcaaaaaaaaaaaaaaaaaaaaaaagacaaggaaaaatagttgttttttatctatctcacgtttattttagattactcaaaataagcatatctgagcttatatctgctgtgcagagcaacgaaaacatttatgggagggtaatggcggtaaacactgtaacttcatgctgacgttaggtggtaacttctcttcgataattcaagctacctagtgataatgtaagttctttattgcacttcaaaagtatttctctgtccatggagggcatttcttctcaaaacactttgtacttccttatgaagttggaatatttgctatggaaaccaaattgttcttcctttggcctgctgaaaattagaaaataaattttgtgtggtcagtaggttattgttttaaacttaactacatgagattaacttctggaactgagatgccaatgatgcaatttcagaatgcagttgttgcactcattaaacaccacagtttgggaaggatccctgatccacttggtgctcagtggctttctcagcctaacagggacatagtttgaagagtcttaaacaaaagttacataagaaccgcagatgactagctgttggttccataggtagattttcttttattatcttagttttcagctttattgaggtacaactgacaaacaataattgtgtatatttaaggtatacaacatgaggatttgttgtatgtacacattatggaatgatcaccacaatcaagctaacacattcatcaccttacatagttacctgttttgtgtatgcatggtgagaacagctaaaatcaactctcttagcaaacttcaagtgtacgatacagtattactcactatagtcaccacgttgtccattaggcccttcagaacttattcatttcatgatgaaaaatgtatatattttgataccatttcccccttccctccttggcagccaccactctactctctgtaaatcattcttcttgtcattagtcccctgtcagaactctgtcgtggccccttccaaacctccccctgagctatcaaagctttcatttactgcctcggtataattaattttcagtgcttatttggccagatcggacctacagccctcagtggtctttaaagtgaaaaaagtgaaaagtctttagcatgaaacctttgatgtgcatgttgtgtgagcgtatgtgtttgagtgtgtgggtgttcatgtgtagtttcatgaacgtgtgtgtgggttttcatgtgtgttgagtcagtgtgtatcatatgttgtatatgggtgttatatgtatggtgtgaatgtacgtgtttgttgtgtgtgttttgtgtgtgttgcatgtgctctgtggctgtgtgttgcatgaatgtgtgtcgtgtgtgcattgtgtgcacgtgccaagtacctggcatgtattttactaggtgcttagtaaacatttgtcacatgcaggaaaggcacaattcctgcctccatgaagctcactgtgtaaactcacaggtgaattgtcaattccttaggcacagggtctgcgttgtgttcatttttctgtccttcagtgtcacacagaggcaggcaactccggcataaaatgtggggctcagatgggaaacaggtattgtataatgaaacacaaatttgctctcaattcaggtttcctgaagcagaagcttgttttcttcaattcacctttgcacacactacacaatcccattcactattatgtttgtcatgtattatccctccacgctctgcaggtgggtagggatttgttggatttgttcctagatacacctcaagtacctggaacactgcctagtacatggtgtgcgcacaataaaaaattggtttaatgatcaaatgtaagagtaaatgagttccggcacatgtggtccacatccgggtttttagcagaacataggtattatgatgtctgtcacagttcactctaaatctcagctggtcttggcaagcagctgcttggggactcttcctcttgctcctgtcaggccctagtgttaatctgcatcctgcagggtttccctcttaggctgtcatcatggagctggcccccgggagatggctcatcctgcttggtcaatggccacgctgtgcccttgggtccttgctgcagcctgtgcactgtatgccattgacccaggggtctgggacatccagccacccggtgctgaccaccatggactttgctgttgcctgcagatgtccgccccccaaccccctggtttctctccaggcatcttctgttcctctggtttctctcgcaacttctatccccctcctcggtgcctaggaattcttgtcagcttcctccgctttgccagaggcagcccttgcagctgtggagccacgtgtcactgagcactgccttctggaaagagactgccatttccaggctgctcctccaccagcccggtgactcagtttctactccttcttctggagttgaccatcagagctgagctcttgccttccttctttctccttctgcagatcttccctctagctctacaggaagggcctccctggctgtgtggtcagaaggtctccactgtccaagtccagcctggcttactctagggtttatgggtccagtcttcctccatgactcttgagatgtcaagcccagtttggggagttcaaaaataccattttctctctctcaacaaagcctagcacattttttaaaaccacattttaacatttctgaaattaggatgcatcttgcaatggatagtaggtcctagttatttggcagcattttttttcttattgtacatattacagctaacgatatttttgcttaggctgttgtcttgctatggatttaaactctatactggagtttaaagccatgcaacacttttttgttctcagccttcatcttcctcacctcaaggtaatagatgcctctcctttaaaaatgtgaagctgccaggcaaccagaatcaagaaaagggcagccctggaagatatacgtttgtttcatacattcaaaaataggattcccagtacctaagatcaccctttgaatcaatacacatggggctggaccaccttaaggccatggactggtttccatgctatacttttaaataaggtcaaagaaaaaatgtgtccatctcacaggggcctggccttcctggaagaagaaaacatactggtcagtaaataagaatagctgggccctttggcagttatagatgtaattttccacgaataaggcagaattgcattccacgcctctgtctcatgagaacataatgagtgtgagacatggagagactgcatttctgagtcaggcctgctgagatacaggcctaaaacttttatactgaagtcagagttttctgtgtcagttctctctctctccctgtctcctatgcacacatgcgcacagaataatgagtgagtggacatgaaatagagaagtgctgtacctggcaatagcaactgaatctaaaaaaaacagtttactaacaggcgtgagtgaggggcgctcagttatgagttggtgattttaagtatcaggatcaggtatgggccaggtttgttcaagcgaaaaattgtagttaatattcagaagggcctcgtgaaacccaagagcaaggacatagccatgtttctggaagaactgggaccagccagggaggttgtctgccagggtctgaaggaatcattcttcatttcttgtctccattccttgcttttctctctctctctttgaaaactggctttccttgttttcagaaaacacagtcactctgcatctcccaagtgatgttcagagctaaacactttgttttgactccatctataacacatatgcattaactccatgtatttcaatgtaaaattcttggggagagcatgtgaatgctgtagctttgggtctagcaaatattcttggccccaccagtcatggccaaggtgtcttttaggctcatgcctgtagactgaaagcagggatcagggaaattggtttactttagtaagaaatataggcatgctgagcaaatatcaactgagtaaacatcaactgaaatacatagaaatcatgaaagatggaatgcagtatactcactctatttccttaaggtacttctgcattccgatgcaatgtttgttgattcaaaggataatgtaataaaatgccaaagttttatcaatcagagacatttgactgcacatgtaataattccatgctatctttattatctgtgaaattgtgtttgtgtcttatgggacaagtgtcatgaaactcattttgagaagcaagctgagattttgtaataaatacatttagcttttttttggaatgaggcatacccagaggtccatgtttaaaacaaattagagtaaatcaaagtagcatttaccataaatattaacggtaaatgaaaaggctaggggaaatctttttaaattgtatcaaaataatactttgtttatacataggacagccacagtggctcacacttgtaatcccagcactttgggaggccaaggcagacagatcacctgaggtcaggagttccagaccagcctggccaacatggcgaaaccccacctctactaaaaatacaaaaatgttagctggtcatggtggcgtgcacctataatcccagctacttgggaggctgaggcaggagaatctcttgagccctagaggtggagtttgcagttagccgagatcacgccattgcactccagcctgggtgacagagtgagactgtgtcttaataaaataaaataaaataaaataaaataaaataaaataatgtaacatgaattcaatgtaaaaaaatttagaaatatgcctacagtgcctcatatgggtctttcttggttgataggaatgagacttggcagagattaggaaggagatggtgaacaagagggagaaggagagaggtgaaagggatggaaaggggaagagggaaagagaaaggggtttatcttgtgagatcacctaagtaaagtactcacacactacctcctctattcttgaggcagggaaaggttagacaagggtgctgtgggagctggcagggtggacacctgtattagtctgtttctgcactgctgtaaagaaatacccgagactgggcacagtggctcatacctgtggtctcagcattttgggaggctgaggtgggcagattgcccaaggtcaggagttcaagaccagcctgggcaacatggtgaaactccatctctactaaaaatagaaaaattagccaagcatggtggtgcgcctgtaatcccagctactcgggaggctgaggcaggagaatcgcttgaacccaggaggtggaggatgcagtgagctgagattgcgccactgcactccagcctgggtgacagagcaagactccatctcccccccaccactgcccccccaaaaaagaaatacttgagactgggtaatttataaggaaaagaggtataattggctcacaattccacatggctggggaagcctcgggaaacttataatcattgtggaaggggaagcaagtgcatctgacatggtggcaggcgggagaagtgaagtgagagcacaggaaaaactgccacttttaaaaccatcagatctggccggatgtggtggctcatgcctgtaatcccagcactttgagaggccgaggcaggtgaatcacttaaggtcaggagtttgggaccagcctggccaacatggtaaaaccctgtctctattaaatacaaaaattagctgggtgtggtggctggcacttgtaatcccagctactcgggaagctgaggcaggagaatcacttgaacctgggaggcgggggttgcagtgagctgagattgtgccattgcactctagcctgggtaacagagcaagactctgtctcaaaaaataaaaaaaaataagacctcctgagactcacccactatcacgagaacagcatgggggaaccaccgccataatccaatcacctcccatcaggttcctcccttgacacatggagattacaatccaagatgagatttgggtggggacacagagccaaaccatatcctcacccttgcggcttgccaggctgatggcagggaacctctcatggtggctcttcctcggctaccacacaaccgtctagagtccattgattgtttagcacatgctgcctttactctgtagagtgtcttgctaggaaaaccacaggagagaacacatgcttgcaactcccttcatcatctttgcatcaagaataattcttgtctcaacaacaaacaaacaaacgaaaccaataacgaaaattcttcatcatatttgcatcaagagtaattctagcttggatttagactggcacaaacaatgtctcctgttcttcttggtcgtagctcttgataaacttattattgtttcatggactgggagcttcctggggaagtgaaggggagagtttctggcatgggttgaggacagtcatgaaggtatgttcagaatgaagtcacatgtagcagtcaggatagataggcaagatacaaggaagaagtggggtatctaaaagggagaaagaaacacagaaagttgggccttgttaggcccttccagccccactgtggcactcactgctggggtatcagctgacatggttaggtgaagtcctcctggtggtcttgggtgtaatatttcaaagcagtgctcacattaataaaaacaaggtctaattagttgtctgtgcttctaaaggaagactgaggaatgcgaagagggtctgtaatacacagtttcccaggggcccatccatgaacaaaactcttttgtgatgcctgggatgcaataagacacggaatttgaaatggttcttcccagaagacttattgctgagtaggtcacaaaccattgacgaggagtggaatacagtcaagagtgaatgagtagacaatcaggaaaaatcaaagaagaaaatagtgtcttcagctccaaccattaccttttttgagggactgattagaaggtttagatcagtggttcttaacttcaacagccttataatgctctttttcttaataactatttcataatatcccctaagtgaaattcattgacaacataacctacttaagcatgatattaaaaatttaaatgtattaccttagctataatgtaaagaagatataaaaggtagtccatattcagtttcatacatacatgtgtagacacgactgagctagaagacagaaaggagttgtcagatgcttgagctatacacagagaagtctttaatgcagcagctgcaaatgcaggctgaaacagcttgtgcctcgctggagagccaaataacatgagtggcattgctgttggggatgtggttttcttcctcccatggtgaaagatcttttataaacttacagaagaaaatcaagtttaacttgtcctcaattgacatggtagctgcttttctggaaaatttatacgtattaaaactgtgcgaaaaatactttgtgtttatatgacaaacagagctaggcttcagactcagatttttatctccattgaggtctggtgagatgtttgaaaggtttttttttttttttaaggatagaggacaatttgttgtgctgtgctgttctaggtgttgcaaaatgtctagtagccccaacttctgcctggtagatgcacacccaaccaaaaatactcccgcttgtatttaaaactcacttaggttatagctaattcccaggcactgtctgtagagattctgctcaggtagggctctagaatgtccaagaggctgcacagctaggcatgggaaccacggattcaagccatccctctctctgactcaccagatccctctgacatatcttgggccagtggctgtccagcctgggttttaaggagctgggtttcagtgaagaatgtcagtaggttcagttctcttcccagcccttttaatgcagaggcccccttgtcagcctagaaggctgttctaagctcctgtgcaaacccctcttgtgaacccttgggtgtggccatcctggagatggttgactggtgatccagatttcagcctctcccttctctgctttgcccagtgtcatgttcaggcccccggctttgtcaaaagagagaaacacttttccctgggtctcaatcctttgaagttccattgggtgagtcagctccccacttagcttcagaaggatccaggacaggttgtcctaaaattaatacctgcacattcatggacagtgcatggtgagaggaggcaaagatggcagagacaactataactggttgtggaaaagagttgagggagagaagagaaaatattattaaatggaagagattgaaaaatactgaaatcaagtgcaagaacctttaatgggcagagttaaatgacacatttattcatccaataaatatataaaatgcatctaccacctactaggcttcattcaagacaatgataatacggcagtgtataaaacagaccaaaacctaccctcatgaagcttacattctagagggggtagacagttaattaacaagaacaagaagtaatatatatagtaagtcagatggtgacacatgctaggaaaccccagtagggacttcaggtaagacagagatgtgtgtgtgtgactgtgtgtgtgtgtgtgtgtgtgtgtgtgtgtgtgtgtgtatccatgcaacatccaatgatctgggatacctatttggcaacaagagaggaaaatctctttggcaatagtgatttggatgttagtagtgtaggaggaatgagaaagccatactgcaattatcaggacaggaaatgattcaagtttggatagaactttttaacaatgaaaaatgaagagaaacaaaaccactttcacatggcaataattaaatttctgagtttacgtaaagaatcttatgaaacttctcattccaaccttttgtttcctttaagttctttattatctttgagtgtttagatttcaattctcgacagttcttcacatattgaatgagtttgctctcctatcacacagagatcaagttatctatgcattttacacttggttactttagacttgagtatttgtgtcgaaataccctcctttttaaatgtggttttggttgatgcttttggaatgaggaatttatcagctgtggtgactcgtatatactctgttagccagaaatactagcttactctttacccgaaaactccctattccaaaatgacatcacactatgagtttatgcctaatgaagctccagtaacatttgcttatttgcatagtagaaatactgtcaggtacacgaattttcagtaattttctcaatacctctatggtattactgaataggtatatcatgctcattttatacgttcaaagaggctgagtatataaatacccaaatataatgaatgtttggcaggtaatgatcatctctatcattgactatgtttaaatactttttatgtattaacttattctctcaacaacccaataagctggggactattgataacattattttgccatcaagggaattgaggcataagagaagttaagtaacttgcttagtgccacacagatagtatattgtagagctgggatacatttggggcagttgggctccattgcctatgctagtaaccatcattctgcacttcctctagttctaaagagcaaatctcaaactcctacatgttttagggtgatttttaactttacacacaatggcagtggtcagtggtagaacagtaaaaggcagcaatgtgaagggggaaaacgatcagttttggagagtgtgttggatcccggttcagttattttactcattgggtaatcttgggcaagttccttaacttctctaggatgtctgttgctgtctacaaaacaagagtagtagccagtgtggtggctcactcctgtaatcccatagttttgggaggctgatacaggaagatcacttgaggctgagagtttgtgcccagcttgggccacatagcaagaccctgtctctaaagaataaaaaagtaaacaataaataagctgggtgtggtggtccaggcctgtagtcccagctacttgggaggctgaggtgagaggaatacttgagcccaggagattgaggctgcagtgagccaagatggtgctactgcactccagcctgggtgacagagtgagaccttgtctcaacaacaaacaaacaaaagaaatcaacaatgaaaccccaaaaacctacaacaacaacaacaacaacaacaacaacaacaacaacaaaaccaaaacaagaactccttcccaaagaaaagtagtaaaccattcatggttataagcattaaatgtgatgtcctattaaagtgtctaaatcatggtcaggaacccgataggtgcttgaaatctagaaatttcattcctacataagggccaattattgagcataggtcagatgaccagttaagaaagctgcggtgcagtaaattggaaagggaattggtgatgttggggaattcagggcaggatttgtaccccctaaaggagcagttcaaatctcaatgatgacttaggatgtaggtccttatggtgaacctgacaggggctgctgtgctgtgaagtattgctttgaaatcggggtcaggggtgaagcagctgttgacgagggtgcccctctcttctgacctcttggcctgccctttcttcttgctcctatgtagacactttcatgaactacacagtggtctcagagggctgcagaagctttatgtagagcagacgttcttgaactttcggtctaaagacaccttcgtactcttaaaaactctcagaactttaaagagcttctgtctacctggttaattctattgatattaagcacattagacatgaaaactgagaaattaaaaaaataaatttttaacaattatttaaaaatgccgataaactcattgcctgttaacataaatctcttttataaaaacaattatttttaaaaaacgaaagtatcaaaaagaattacctttttttactttgtttacattgttctggaaatctctttaatgcattgctcaacagaatacagataagttctcatatctgcttctgcattcaatgttggagaagttctgcatcatgcggtctctggaaaagtccactgtacgtgtgtatgaaaaagacacataccatgtttgaattattatgaaagtagttttgaccttgaagactctgaaaggatctcaggaacctttgagaactgataatataacgtatctttttcttggtaataatgtttttgaacattctcagtattccctctcagcttcctcctggtgcctgtgttcaagcaatcacaattgctaatgattcttcttgcaaaattcttaggtttggcaaccctggaaatagtagatttgatctttagctgtctccctcactcttatctttcctctttccttgacagctgttctttccttttcactcttggtggcacaagcttgggaggttttccatccaggctggtgcctcttaacttctctctctgcctctagggcctgacagctgccaggctgtcctttatctgacattgttcacagtttacttccttcccccaaagtcttggttttgactaaaatgtattaattcttggttatgttttataaagatatcaaaaactttttcaaccaaagtttaaaaaagaatttgcagggtgggggtgggcatgtgtaaagaatctcaggcatcttcactgatgaacttcagaaactgtgtcagtagatttctgatgccagccaggattgagtaataggccctagatttactttctcataagaaacaactaaattactctacaaaatatgcaaaaccagggtttttaagaattggacatcagctaaggaaggatagtgatccctgagaggcagaaaacaaagccctgtgacttctcctgcttactgatgtgagagtttccaggccatggcacagggaagcgtgacccaggcagagtcagtgagaagactacccaaagtcagaaaaagcgcctccctaaaagattagatgaaatagtggacaggaggaggaataattcctattctcaccagccagactggaaagtctcgtaattcatagggatttgttagaggactcagaagcatcaagcttcagaagtgggataaaatgagtcctagagtgaatggtgctgtggtcctgtctgccgagtcttaaaagcaagatccaaaagaatcaaactattctcaataactcaaatgcatcctaagacacaaaaatattcagcatctaacaagttaaaatccacaatgtttggcattcaaccaaaaaattaccaggtatgcaaataaggatgataataatgcagaggaaaatgagtcaaaaccaaccaagaactaatagagatgttagaattagcagacaaggacatggaaacagtttttataactgtattccataaacacagaggtaagtagagaaacaaaagacgtgaaaatgcctgcgtctaacttctagagataacaactacaatttctgaggtaaaaaaaatgactggatgagattaatagcagattagatattgcagaagaatagatcagtgaatcgaaagacataacaatagaaactataaaaaaaaaccacagaggaggaaaaacaaacaagtaaagaacagagcatcacgaaacggtgggaaaatttcaagtcaccaaatacacatgtaattggagtcactcaagggaaaaagggagtgacaggaaaaatatttgaagaaataatggccaggagttctccaagctgaactgaaaattacaaacccacatacccaagaagttcagtgaaccttaagaaacttgaggacaaacacatcatttcatcataattaaatttcttaaaatcagcgataaagaaaaaatcttagaagcctgagggaaaaaatacgcctaccaagaaacagcagtgacacagatggtagcagattcctcatagaaacaatgcaagctagaagagtttggagcatgatctctaacatactaaaggaaaaaattgtcaaccaagaattttatacacagtgaaaatatctttcaaaaacaaagacacaataaagccatttcagatatataaaagctgaattaatcactaacagacctgcactacaaaaatgttagaggaaatccttcagacagaaggaaaaggatactagatggagatctggatctatccaaaggatagagcaccagaaatgccaaattattatttaaatgactttaaatgaaaattatttaaacagaagtaataatgatgtagtgtgaggtttataggatatgtaaaagtaaaatgaatgacaaaatagcacaaaagtcacgcaagggaaaatgaaactatactattttagggttcctgtatgtagggtgatacagtatcatttataggaacagttttagcactaaatacctgttttaaaaagaagaaaattgtcaaattggtgaccatagcctccaccttaagtaactagaaaaaggaataaattacacaccaaacaagcaaaagataagacataataaagatcaaagcagaaagcaactaaatagaaaacagaaatacaatcaaggacatcaatgacaccaaagctttgatgtcatttgatgacacctttgagaagatcaataaaattgataaacctttagctggattgactgtggattaaaaagagaagacagaacaatcaatggtaggaactaggtaatatcactatactacaccacaaatagtaaaagaataataagggaatactaggaacaaaattaggcataaaacatatacttttagatgaaatagataaattctttgaaggacccaagctaccagcttcattcaaaaagaaatagatgacttgactagccctctatctactaaagaaattgaatttgtagttaaaaatcttcccacaaggcgcagtggctcacacctgtaatcctagcactttgggaggctgaagcaggaagatcacgaggtcaggagatcaagaccatcctggctaacacggtgaaaccccatcgctactaaaaatacaaaaaattagctggacatggtggcgggcacctgtagtcccagctactagggaggctgaggcaagagaatggcatgaacccaggaggcggagcttgcagtgagcccatatcgtgccactgcactccagcctgggcgacagagcaagactctgtctcaaaaaaaaaaaaaaaaaaatcttcccacaaggcaaattccaggcccagataacacgtcttgtgaattctaccaaacatttaaagaaaatataatagtaattctactcaaactcttccagaaaattgaataggagtaaatgcttctcaactcatgagttctccccaactctgtgaggctaatattacccagatatcaaaaccaaacaggacattacatggaaagtacagaccagtattcctcatgagcatagatataaaattctaaacaaaatagtagtaaatcaaatccaacagtatataaaaaagctaatgcatcgtgaccaagtaggtattatcccaagaatgtaagattggcttagcattggaaaaatccataaatgtaattcactatattagtgaaactaaaaaaagaaaaacaatcatataattgtctcaacagatgcagaaaaagcacttggcaaaatccaacatctattcctggtgaaaactcttagcaaactgagaaggaaacttcttcaatccaataagggatgtgtacgaaaggtctatagctaacatcatacttaatgaaagctatcctcctaggatcaggaacaaggcaagaacatccactttccccacttctatttaacagtgtattaagggatctagctggtgcaaaaaaaaaaaaatcaagatatgaaataaaaggtatccagattggaaaagaaaagaaattctatttgtagacaacatagtggtctatgtaggaaacactatggaatctattaaaaatctactagaactaataaatgagttttggaggttataagatcaatatacaaaaatcagttgtatactagcaatgagcattcaggaattgaaatttaaaaacaatagccttcacaatagcatccagtaatttgaaaaacaggaataaatctggccaaagatatgcaagatctgtacgtgaagcggtgttgatggcagagactattctgcccctgagcccacgatgtgcctggcactgttcttgtcggtgcactcaacccttcctgtcttaggctgctctctctgcagtctgttcagggtctttccaaattaccagctttttctgggtacttcagatacctgcatcactactttctttcttttctttcttttttttttttgagacagaatttcgctcttgttgaccaggctggagcgcaatggcacagatttcggctcaccgcaacctccgcctcctgggttcaagtgattcttctgcctcagccttccgagtagctgggattacaggcatgtgccaccacgcccagctaattttgtatttttagtagagacgggttttctccatgttggtcaggctggtctcgagctcccgagcttaggtgatccgtccacctcggcctccaaaagtgctaggattacaggcatgagccaccatgcccggcctgcatcactactttcaagaagatagcagagaaaacagaaaaagcaatcaatactttctcaatcaccatgttcttcctgagggtctctccttctcttgagactgcagaaggaagaaactctcatcctagtaaacttgtggctttcctcttcttttaaacttttacatgctgggactcattcttcgtgttcttaggaaaacctgggttctgggtgcatacctacacctgtttttcacgggcatcttctaatttagagactgtttccctgtgtcattattttcatgcccagatttagctgggatattgctaggttatttacaagcacacagctaatatgtcaaaggaacaaggcagaggaccataactcatttttttttcttggagaataaacaaaaaggaatgacaaaaatgtagaacatggtaagattttacaattttattggctaatataatgctatctaaaatctgttttttttaaaatcaaaaggtaataaacactctgttgctgattttatgaacctatgcctgggaaccacagtgttgcctctgctggatatcactgtgggggcagcagaactttgtgggcggtacctacaataaaaaatgctttacgctgttctttgtagctgactgcttctgacattctgagcattgatcgagttgcctatgaatgttttgggacaggggatgaagacactcctcacccctacaaagtacatgcattcctatctctgaagctcttatatttatttttactaaaaaattagaatataggcatgaatccatgtatttacaaagtattatgttaatgaatgtaacaattataatgttattcaaactgagaatctaatatacagaggatatgtgagagcaggtaggatttgatcaagcaatgaaatacagaacgaatgatcacctggttgatcaaaaggaaagaggaagagtgtgaagaagattcttgctcgagtacggatttaaaacgaccagattgtccattttggatgaagactggctttctagagaaggacttttgttctagagtccctgaattatctaaaccttaagcagctatgtccaatgaacattttgcggtgaaggaatgtcctatatctgttctgtctaatatgatagcctctagcaatgtgtgggtattgagctcttgaaatgtggctagtgcaactgagggattacattttttatttcatttaatttaaaataatttaaatagtcatgtttccagaggctacatgaattgcacagcacagatctggaggaataaaagggaatccagtagccaccttctgagactccatgcctaagtcacactcaggggaactctgcccaaaatcttgtccagttctgggtcctaagtctttcatgccattactggggaattcacttgataggcttctattattctctgtctcaggaggactcaagatcagtggctttggcctctgaggacaaacaagcttatattctaaatggtatgctgagcttttcagcaggtctaactatcccagagtaggaacaactcagcactgccatccaggctcttaacacagtaatctacccgtgatagggcaagaaacaaagaaggaatcagtggtcctatcgcctcttctcccaacccctgggcccgaggcagagaactttcctagctcccattgtccctcagggcaatcatggataacagtattttttttttttttttttttgagacggagtctcactctgtcacccaggctagagtgcagtggcacgatcttggctcattgcagcctctgcctcctgggttcaagcgattctcttgccccagcctcccaagtagctgggattacaggtgtgcaccaccatgccaagctaattttttgtatctttagtagagacggggtttccccatgttggccaggctggtctcgaacccctgacctcgtgatctaccctcctcggcctcccaaagtgctgggattacaggtgtgagccaccgtgcccggctggataacagtaattcttgatggaaagccattcacctattgctgagctgttgccaagttgtttgttctgaagaaatacaagaggaatggttgggtgtgaatgtaatagttggacattagggaaatgattaagcaaatatggcactcctgcatctgaccagatttttcttcttcctttgctgatagtggcctgctcttcactcttccaagtatctttactagtggagacttacctctcatgggctctgttagttcccagaaaatcactgaatgacaacactagaaacaaaatcattctagttaacatttcctcaaaagtacatagttatagctacttcttttactcaaaatagtatattcaaaactaaacctatttgaccatctcatagctctcagcttttgtttgctggtcataataataatcttaaggaagccctttgtaattggacattgctcagaggtgatgctggagaagggaggataggtgttgtttaattctgagacaccttgcatgctagactgaagttatacggtacaagataagccatggagaactgtgacacattcctgagtacagtcattgttttgatgatctattattttgctagaatctaccctgaaacttgatgactcaaaacaacagtgtattattatctctcatgattttgtgggttgatgaggctcagctaggtggttctcatttggggcctgtcatgcagttgtagccagacagccactaactagaattgactggcctaacatccaagatggtgcactgccatggctggaatgtactttggctgacagctggggctgtggactggagcacctgtacatggtatacatgtggctcgagcttcctaacactatggtggtctcgggacagtcatggtccttacctggcaagctctgggcatcaagactgagtgttctaagagtcccaggaagaacctgaaaggctttttatgattgagctcagaaatcccagaaagtcaattccaccatattctattggttgaaattgtttgaacaagtcaataagccagtccagattcaagaggaggaaaattagactttacctctaaattagatgagaagcaaagaatttgcagttatctttagtttaccacattgatcttattaaaaggaagccacctagagaaaatacattgacagttatattcagaaagattaaaaggttgaaaggctccaacacaaaaatctagattttggaaattgcttgtgtaaaaggaaaagtgacaaaacttagagatcaattacaaaaaattgcagaaaaccaaagatggtgggactgtgtggaattacaagggaaagagtattacatttaagaataagtttaaaaagggttgtattcttcctacatgtctggcatatgatggagaacagaggttagaacaggcacttcttggatgatgggaagggctgccttttgggtgaccatagacagttcagttcctggtgcttcaaattttatgtgttaaagcaatcagaagccagtggcatgagagacagaggccactaatctggttctgttaggtgtaacagtacttggatgtcgccaagtctattggcctctggaacttgctgtgctatatctattaacatgggaaaaaccaggtgcaagaagcctctttcactcatttgccttcactgagcaagattcaagctgcaattagcacaaacagttggctggtttgcctgtcacttatgtcttatcttcctcctcttattaaggaggttaagaaatggtttattgcctatgaccgtcttatgaaatatgtcacactttctcatcagctcttatttcctgttcacatgtggctttctggttggtaaaggttttattaaatcagaggaatttgaacggaaagataatcatagtagcccaccaccaattgcctagggaaagggagagtgttgagtagattgaaattgagaagttgtagtgagaaaaagtaaggcgaaatgtagataagaaaatagttacttgaaagtcagcagatggaaaatgtatgagaggagcgataaaaaacctaggctgtagaaggaagtccatctaggacagtggtttccaatctttgttgtggttctgtgagagtttactggcagtgccataaataacaaaaatatgtgtagcaaattaagaatcacagaggccctctgtgcaaaaatgtaattttctttatttctttacaattgaagccaactagacttaggaattctcatttccacctgatggtagaaaaagatctcactaatttagagttgttttgtccccactggttcaagactcagtctctctgggggtagtaacacaatctcttcagaattctttccttccaaaccctgcatttgttttttctgaaggatcaatggagttctttgggggtggtggggctaaagtggaccgagctgaagaatggttgtcctggtgtcccgggaggggttctggtccatgagttatcctctgttcttgaaaacttcagctaggaccatgcttgtcccatcagactaggtccaagggctctttggtcttcttagcttctgcactgccccctttgagtgtctggggactctcagctgctttacttgaacactctgggatgcactggacttttctcaaggcagcctgtcctcaggcccaggcatatctgctgccaggcctgctgtttggctcaggccatgttggacacgggggctttgctatgaccctggtggtgtccagaactaggctgggaagccaaatggcatccctctcttccagtcttctccatcaacctcttcagtcaggaggaggccaggtgatgcagtttggatatttgtccctgcccaaatctcatgttaaaatgtaatccccaatgttggaggtgggggctggtgggagttgtttggatcatgggggtagatccctcatgaatggcttgggccatccccttggtgataagcgagcttttgctctgagttcacatgagatctggtcatttaaaagtgagtggcacctcccgcacctctctctcgcttcctcctgctctggccacgtgacgtacctgcacctccttcaccttctgtcatgattgttagtttcctgaggcctcctcagaagcccaacagatggcagtgccatgcttcctgtatagcctacagaaccatgagagaattaaatctcttttcttataaatttcccagtttcaggtatttttttatagcaatgtaggaatggcctaacacaccaggatttctcttattaggtggtgctgaagagtggaagctctgagtcactcctcagaaacctttcagggtctagtaaagagcagctccctccctctgcttctccccttcccacctgctggtcaactctgttccttggagtgggaacaaaaacaaatagctttacattaccatacattcttctgtactccgtggtttatgatgtaaaccttatggtctaagttgtccaatactttggctttggaggttcaaggaaaaaaaacataaaatacttcttctttcaagcctagccttaatgtttataatggacagtctttcaaaatgtcctgccacatgggccataggagatgctttatttttcaggcattggattatgttgtgttggtcaatatgattttgtttcatgtgcattatcagaaactcttcccaaagagggtcctgggatctgatcagctagacaagtggaggagaaactgaaaaccctcaggggacagggtctcagttaagtctcctgaatgataagcatttcagaggtgggagggagacaccccggaaggtgtccagaggctaacaatgctatttctgtttcttgtaagtttttgtccaagatgtgggccattggattgcatcactagcatacaatgtcagtgtaagcagtaggctttacactaaagcatgttgatgtgctcagagcatttttgtggtgctgagaccagagcagatagggatacagggatgacagtctccaccttacggaagcctcctacccaggggatggagtgagacaggcaggcacaccagttatccaaggaaaggaaataaagggaaggagaaagtcagtgaaagtggtcaggatggctgagtgagggagaaggtgacttgaaggtcccagatagaacagtggtaataaggtgagaaagaggaggtcttccaattccatttctgtgttgggcgggtgtttgagagtcccacctgggtctagaggcctgcatgtctagcaggacactgggtaggagtggctgaacggggacaacacttaaaaaagacaaaaattacggattttatttctacatggttgcacaaatcaatttcactttctacttgtaaactgcttaaaaaccttcattatgaaaatggaaggacgaatttatgttcaccatcatagtgcttctgggctggttccacagcatggagccaggcccacctgctgtagctttcagaactgccatttggacacgtggttgaagcagccttcagttggaggattcacagtaatggcatcactgtgggagcttagaggaacaactgcttgcaaccccagctgcactggaattacctgggagctttaaaaacactgccttttgggcctcagccccagagactctgacgtgactgatctgaacacaggagtgtcatgtcctccggtgattctgagtggagtcaaggctgtgagaccttctgctgtataaaggaatattgagagctgggattgttaaggaattctcttaatgctacgtcactggcctctgatgtaagcctgctttctcgaggaaaaggaaccataaaagcttctggaaacagattgtttaagaatgagaaattgtcatcatgccaggttgcaagacagcttttagggcagatgagcttctgctgctcattccttcatcttttcctccagcctggatttgtccgggggcagctgaggctcaggttacctcaattcttgagtttctgaagaggcatatccaggggtgggttacgagaacaagagcctgcccagtctgaaagggatgcaggaaggggcggtgtgtactagaaggaaggaagctatcatcatttattaaaactcttcttggaggatggcccatgaagacctccaaacaagctggaggggccagtcacttgctgaagactagcgaagtggagggggaaagcccgagggagctgcagactcgaccactgcgccctcccctcctctccctgcaaggagcccaaggtgtgatcctgccaggcgttcgttcgctgcatgaccttggccatccttccattcccctgggtgtgaattctcattggcaaagtgagctggtgggcataagtgggttttaagtttaaaaatttaaaaaccctgtctgcccccaagtgtggtatcaagattttatagtatgacacttaaattgcttttttcatccgggcgcgtaacagcaacaatgaaaccagcagataacgcgtgagtagtatcagctctgggcctggcactattttatatgtattagctcattttttttaaaaaactgttttcaaccactccatgagatgagtgctcttatgatccctttttcacagaagaggaaacggaggtacaaagaaattagtgcacaaagccagtcggagagagcccctggccaggcaccaagctccagaggtcgctctggcgagcgtttgcttcgggatctgatgccctggagtcgccaactcaattcgcgggtcgcagccaggctccatgggggtagtagagccaggtcgtagtggctaggtgagttgtctcaactaactctagtggagccgccgcagccctggaggagccgggccgcgactcgagagcgcccggcagctctccaatgctttggaaccggcgggacccctgcgggctacccggggcagggcggtgtccgcaggggtctgtccagccgcgcctgctcctccgggtggagagttgggacacccggccagctcgctcgcagcccgcggactggcccagccgagccgtctccgcccgttccccgcccccgcagcggcggggctagagccagagccgcgcccggcagttcccggccgcgagggcgggcgcagcttgtggccggcggccggagccgactcggagcgcgcggcgccggccgggaggagccggagagcggccgggccgggcggtgggggcgccggcctgccccgcgcgccccagggagcggcaggaatgtgacaatcgcgcgcccgcgcaccgaagcactcctcgctcggctcctagggctctcgcccctctgagctgagccgggttccgcccggggctgggatcccatcaccctccacggccgtccgtccaggtacggggaagctggagcatccggggactaggtaggggtgagacggaccacagccttgacaccttcgagtcccccgctctgcaggacgccgtgagcgtcctccctaagttgcacttggttgtcagagtgtgttgtgtaagaaggggatggcggtgaggtctgcgtgtgtgtgtttcttgtgtggagcaagagttaacgttgttcaggtcgtttgaaggaacttgccagttgttctggaggggggttctaggtaggtgtgtgacttcccgtgtgaatggctttcaggttttctatccggctacgttctacaggttcaggagcgtccctcttagaggttaggctcaggaccgtcagtctccttaacaaggtaagggctgaggccttaaccacactggggagggtaacttgttgcccctccagataaaggatggtgctagggaatgtagctacaagcaagtaggcgctgagaagacactcattatttacaacagtcatgcccagcactttacagtttataagcccttgacagcaactggtcttttaccctccctacagtcttgtgaggagggtgctgtcatcacccctgttttacagcgggggaagcagaagtttaggtgaccaacttgttggaggatgatgtcctgaaggagggtaagacctctgcatgcagcccccctctgtcttccctcccactcgtcctgcctgccagggctttctcctctgcactgccgggaggaaggaaggccgctgggaaggcacgcagatgctggctcctgctgggctgtctctccactgccttatctttggggcagggtagcttctcagatggccacattcctgtgatttagctttacattctaggaactgaggcaagggacaccatgaacttgggctcttgaggtcatggagcaagggtccattcgtcacgggaatgtgatggatgtctcagtcgctgcggtttggtgccaggcttctggacattgaatgtatgaaacagaactccatgactattgatgagctgaggaaagccagaggtggcatggggacgttcactgtcctttttgccatccagtttaccaagcggctattggcattgttttctttctcaatcccttctaatttattgtgtgatatctcatttgatatttcatttaatattctgtattcatatccgatgttaacgtttatgctagacagaaaggtagagcctttgagaatggggtttgctggggcaggggtgtggaactctgatttattttcagtctctggctagctgccaagctgctgtgtgtgaagcgtctcctgcacccgtccactctcatgtggcctccatgctgttcaggaaaggatatttgatctgaattctcacatgaccttggcaggcccagagcagcacccccatttctaataggccctgcttgtatgtcataatgtgacatcaagttttttttttatggttctgaaacctgtgacatcttttgagtcaacctctcaccattgttgaaacactgcttaatagtagattcactaatttattaaagatttattgactatctactatgtgccaggcactgtggtgagtggtggggagacagcggtgaatacgacaagtgaaaacctctgtccccttatggacatgagtcttcttggtaagacataggatgtcagcagtctctcttcaaaaggggggtctttgaaatccgcccctttgtacaagggtgtggatgcactggctacctagaggacaccactcagcagccccaatggagaggacgaggagatgatgggcacagatgtagctctgtggttccctagagaatcgcagggctgctattctccaagtttgtggtgtcccttgcctcagttcctaggatgtggagctctaggaggtggagctacactctgtggcttggccatgcacagggaccagggcagatggaaaccctgtggctgggatgcatcagtgcgagctgagtgtccacctgcaagctgggacattatggagaagacatctcagtaataagagaggcaaagctggacaattgcggtgaaactaccatagcatagtgggtggagaagtacagagatccttatattcttatgctacataatggatatactaggttcttgccattttaaaagaagttgtcaggggcacctgtggctcacctgccatggcacagctccaggatgctacccatctgttgccgtgaatgggtgcttggtttgcattttcttcttcttgaggttgtgaggtgggctggtggcacaagacaaggatctgcactgtcagcagcctttttctcctctggttgtctgctgtgggtccaggaaatgctgctggagcctcccggccatgcctagtgcagggagcatgtgggaagccctggccccgagttatctcaccaggtactgaaaggggctggagctctttaaggtcccagtcgcctgcatgttggattctgtgctgtctcctcttcatgcacatccaggagctcacacatggcggcacgatggagacacctatcacttcccaagaggactcatgcccacgagcggacagggggtctcataaattaaaagtagggtaaaaggaaaacaagagcggagatgaagtggagtctgaaatgaggcttgacatgtgcagtgtaaaccctgatgacctagatgctgctaaagttactcaagtggggccgtgaatgtggagggaagcctgagtcttagctctgcctgcaccttagcactgcctgaagcactcagggaaatgccaggactggatgcagagcaaacaaactagcatctctggaggcgtgctgggcacgggtattttcaaagccccccaggtagccaaggttgacaacataaatacataaatactctttcctgtaggcagtgggaaagaggaaaccctgcagggcacagccagcagtgtcttcaagatgaaagcaaagtgctcaggaaaaaaagcattcttggcacagagagaagtgggaagtttcttttaaagatccctgaaaaagaggtgagaatagtgagttttcggtggtctcttgaaatgaccctccctgtaagcacagttcggtaatcatggttcagcgagctgtgaacaggaagagtctagccatgctggtctctgcacatttggcgtcccaaatgtgagaactcatagatccctgaaaatacagccaatgactaatgactaagagttaaatgaaaagttagatggtgtcactttccatcagtgggtctcacctcattaaaacccaacaccccccttaatgcaaatattttaaaacaccccttttataattttgaaacgatataataaaacttatctacaacataagtttaaaaaatcaatgtaatacttagatgttaaggagaaataaaagcaatttgtattaaaattatgcatttcagtgtgcagatgcttgagctaagctgaactacaacctagtgaggtgagccattgctttctatagtctgcaggacagctggcatggggtgggaacaggtgagtctcagtggccatccaaatgccactgaaggatgaatgactctcggttaaggtcttgatggtagccaaaggccattcttctctcaattttcacagtgattgcattcctgaaaaatttagtgtgtataaacttgtgccaacaatatatgtatttcatatgaatgtagaagggagttggggggctaggcttcaaacattgtaaatatgtttccgtcagtatgaacgtctgtgagacctctggaggtcatgcaggacaagtcttttctgagcagaactgcctgtgttgttccggatgtcaagcatcgatggcctccaatgctaaatgcatcctgatcacccagggtccccttccccacaggttccgaaatgctccctcaagggccatacccactccactgagaaccactgctttccctgcattgctgggtagtgagtgattaaagtgccattgcaggcgtgggtgccgagatagcagggcaccggacatgtctaagccagccatcaggaatgcacttccgttgcttgctgtaggatggtagaggtcgagttagaaatcagaaaggttggtgctttgtgtgtgggggtgaagggccacaagggaactttgaggggtggcagaaatggtctacatcctgaagtattcctggtgcacacagttgttgcaatttatggaactgtccacgtaagttttgtgtgtttcaccatgagcaatatggtgaaaaatatttaccccaataaaaaaattatagaagtgaaaacaatgtaacgattcttgtagagaaggcttagtcctctgaaactgtctgtggatcccaatctgagaaacagctgttcttgcctgactgggaggcagtgctccagggagaaaggtctctggttctcagtcaactttttgacaagtccagtgcaatagtggccttggcatcgtagaccctggtggctggagaggagatgtgttggagttataggggaggctgggaagcacaaggcagggcatttagaaaggggacaaaggacaagagatgaggcccatccctgtctctgggttctggttctgttgtccaggagccctagaaggtttgtaggggtgagatggaaaagtcagacttcaacctagaacctagtggtcaagaggcttggggtaggtccatccccatctgtggcatctggtgacggtgatcctgtctttctgtgtctcattgccacttttgcccttaaaatccacatgccttagttgaaaccaccaatcttgtggcttttcgccttgtattagctgaataattgagatttcatagcgacacttgaaacctcttgggaaatttttactttatcttcatatccttgtgcatcctcaatgataaaaataaaactttccttctcccatttacatgggtaaataagccattgataactatgaacaaggctttaggattcctctactgataggagcattgccaggcttggtgtttcctgggctttctgagatggtgagtgagcttctgtttccctgctgtgggagtgtttactcatagtttggtagagctgtttctctgggggaaaatcagaggtgaccacattgaacacacagttgggtttttgggttgtgtgcacatgatagagcgtgggtgactaatctccacgagatggaaaccattgtgtcacctttggaacacactacagtggtccccagcacgctctgtggttatttccacactttcctgctctagcttgggtagggaagttcctgggtgggctctgtgatcattaggggtaggtcactccctctaatttgccccacaggtatgagtgtgtggggctctgatgcttccatttctcatcagaattgcatagagattattatggacatttacttaggacagtgcctctcggattttacctcccagggattccttctgggaaataaaaagcaaaggctcaacctagcactccaaagcagcccactgcaagtgatgcttctttgaagcctcatgttttgtcttagatcgtggagatttttctttctgcttcataatatagccgtgtttgctctaatagaaaaataataactcccctgagaaaatctttggatgaaattagtaacctagggagatagacttcaggctctctggctgtctgtagcttctccctgggaatttgtggattctaagccagggcttgtgtgagtatggaggtctaaagttttttccataagtgtgtggttctatggctttgtaagtcccttttaccttctttttcaaactgacatttttgtttttaacaatgatggggactttttaatagctgtatgaatcttataacaaaggaataacacaggaggtcaaggctgcagtgagctgtaatcacaccactgcactgcagtctgggtaacagagcaagactctgtctcaaaacaaacaaacaaacaaacaaacaaacaaacaaacgggtaacaggaagacatcataattatgggcttggtttcagtactgtaacacattccccgtacatgtttccaccgattttcagtagaacacatgggctgtgacatttcatgagctaaagaacctgctttagcccttgttttttcaggactcattcatggtcacttctcagttatggcaaataagttggagcctaattttctaagtatctctccattacatcagatctacacatatgcacatattggttaatatttgggatgaggggctgtattaaatgatgctgtaaatgcatttactcattactccatgggaaggtagaagagtgtgttgctatcaggtggaaatgtagaaagtgcagtgaggattttcttgtaaatctcagatttggggcttggctatgtcaggtccctggaagaaggaggagtcatttactgccgtctgttctctcctcttgggcctctgtagagatttggccctatgccttggcgggctctgctctgcagcttggccagacacatccctcagcatggcaagaagtgtggaaggtcaagaggatgtgcccacttggcctaatcctaacccaccagcacccctgttcttaaccatgtccctcatgtacctgggatccctgaattccctccccaaacaccctggaccctaattccagggcctgtgtggtcattcccatggactcaactgcctggttcatagactggccagggctgtacagagggggatagacacaggtggacttcgacacctacctgtgtgcatgctcagggccccttccaatatggaagggagctggggagaggctagagacagaggaatggagattaatgtagctagacacagcaggagccatgcggtgggactgctccgtgcaggtctcatggtgaggacagcgcagcctatgttttgacagacatggaataccaggtgccaggatgagcttcccccagctctgggcacctctgctgccgctgtccccagaagtggacctccagcaggttctgatactatctggggtgcgcctgctgtgtgccaccttgcctgtgcctagcttctatcctagaaggcagggctcacaatgtgggggaattcctcaggaataagaatggaattcctcaacattgtggaggaacgttgtgggaaattcctcaagaaaaagaagctgtttaataaatgcactgtggctacacagcaggaaaaatgcctccttcccctgcactgggccctaggccttgaggaagaaacctgggttcctgtgacagcccctctctccccagctgtcacttttcccgtgcgtgcactgggtatgaaattccttgtagagggacaggaaggtgctgttggatgaggtcagtatttcctggaaggggggcttctgttgggggccaatatgctcattgttaattcttgtacttaatttctacttttgtaatttgtttcacattacagtttctcattctgggactagtaggaaattactttatgcctcaaatatgcattttcattttgtctttaatcaacaagtaactttgtgtgtgtgttgcacgtgctgctgtagtcacgttgtgatacgccagtgttaccaaatacgtcatgatcaccaaacagcgatgggggctgtatttgggaagatcttcacaattgcaagcttttggatgtgattgtcacataaagccgtggtgtgctgcagtgaatggacaaggcctccggaagtggggatgaccagcctaggccttgggtcaccctaggatctggctgactccctgggtctggacatcagcatctcagcactgcccgctgtctttcctggaagctgctatggagaggatgttagccagtccaggggtttcacacataacatagatatccttgcttgaaggctgaacagggggaaccgtatgctatggcttattaatgtattgagtaagttaatccttttctctttcttgttttattttatgtggaaaattcaatctgaaaaataacagtggcatacacacatctgtgactttttaatgttactggtattttctaaaggtacgttttgaatcttactataagtcatttaaaagaattacaatggactttgattaactagttctgaataagagaggtttctttacctagtatgccttctggcagtaacatttcttagtctctagtcctattcctgtagttccctctcctcagggtcatccccacccctcaactctttcgacagccatctgggtgtgaactctttatctaactccttgtgtaggattctaccctctcttatatgattccggccatctccagaccccagtgacggttcccttgcaatcctattctctgacctacacccagtacccttattccatcctttctcttctttgattctaggttgggttttcatccccgtgtgtctcatgcaaaaatggtgggtaggtaggtaggtggattccttccctccctccctctctccctccttcctttcttccacaagtatttattgagctgttacaacagacatgcaagatgtgtaggatgggcctcctcatgggtgtgggagaggggagggtctgctctgcactgctttcttccctggcccaggtagggaaggccaacaactagggagctacccaatgttaccagagccagggggcccagagccagcagttcaaggcacctcggtgcattgcaccagggagagcctgtgtcactcgtcatgcctggctttggaggagcagatgtctgcaagggcgctgtgggaagcttctgatcagaatcagctctgagatggtcagaaatctcagaagcttccaggctaggattggaagaattgacttccagacccaggaggtgccatagaggtgcatggaggtggaatggcacggtgcttataaacggcaaggtagggagccagcgctggacacagagccagctgaacagtgaaggcagaagagtagggggcgctgaccctcatcccaggggtcaggcagaaggggccgatgggatgggtcaggtgctgcagagatgttcagtgggctggagacagaggggtcttggcatggagaacctaggagggatagtggcctgggcagtgcatctcagaggagcagtgagcttagagggcacatggtggtcgcttcagcaatggatgagtggtggagacagtaagtatataaattcttaagtgaagtttctggggcagaaaaggagggaaaatgaggccattagaagagtgtgggggccaggtgcagtggctcatgcctgtaatcccagcactttgggaggctgaggtgggtggatcacgaggtcaggagatcgagaccatcctggctaacacggtgaaaccccgtctctactaaaaatacaaaaaattagccgggcgtggtggcaggcacctgtagtcccagctactcaggaggctgaggcaggagaatggcctggatgcgggaggcagagcttgcagtgagcctagatcgcaccactgcactccagcctgggggacagagcaagactccgtctcaaaaaaaaaaaaaaaaaaaaaaaaaaaaaaaaaaaaagaagagtgtggggagtcaccttctctgcaagaagcttcctgggcctcccaaataaatccatccctcccctccccctccccctctcccattccatacattttggtgccattcactatataattcccagcagctgctttcatatctggggcatactcacaggggtcagtcaggagggcactgtcctaggactgggagcgggaggatgtgggggtctcccctttgagtttctgctatgatgtgattccaattgatgggccaacacacctctgataccttgtgttatgctgtgtactgcctcaaagtgaataatagcttgggatttagtttgtgtagtctaaggaaaatactttgtgttgaactagtcaggctgtgttattgatggccattaaaaggccttgtgcttaggtcttacaagcttttcaaaggcccaaagaaatgattcagacaaaaaaaaaaattagactccaaaatactaaaagaaaactgcaaaaacaggtgaattaatggtgaaagatctgtaggacatagcagtaaggctaccacaacccagctttttgaggttgtcttaaattaatgtgatatggggtgtaggtatgttaacatgcttgataatggaagagtgaggatacctgcttcttaaacagggcctgctcatttttttctggcctctagtacatttctttctggcaaaactcaagctctgttttcacggagatgatgcactgagccatggcatccctaggtggtttgattcatttctgcaccccggtgtctagcaaagtgccacgtgcatgtgtttaatcaaaatagcttgtggttgtcaagctctttgtattcttccctccctccctgtgatttgatttcctgaaagtatcctttccccaaggattatggaacatacacttgttaaacactggacccattttcatgatcatttaaatgtcatgacctttctgacaccttgatatggtttggctctgtgtccccacccaaatctcatctaaattataatccccatgtgtccagggagggatctggtgggaggtgattagatcatgggggcagtttttcctatgctgttctcatgatagtgagtgaattctcatgagatctgatggtttaaaagtgtttggcacttccccccttgctctctctcctgctgtcatgtaagacgtgcctacttccacttccaccatgattgtaagtttcctgaggcttccccagccatgcggagctgtaagtcaattaaatcctctttcctttataaattacccagtctcagatatttctttatagcagcgtgaaaatagactaatacatgcctcttgagatcctcacagcaattggtgcctttagacctcttcattcacacttcactcatgtgttcttccttccccaggtagacgcaccctctgaagatggtgactccctcctgagaagctggaccccttggtaaaagacaaggccttctccaaggtaacagggctgagtcaccccagggtcccaaggccggccttttctcacaaatagctgaactcctccactctcagatccaggggccctggactatctcccattgtatgcaaaaatattttatttccgttgacacattactctttggggcagcttgatggttttattaaattttggaaggaggcttcagccccagtaacagccaatgcctgtttgctttcccaggtcaccttgactgtgctacagtagagacctgggaaatgatgggttccagtgctgtggccaagctctccccagtttcaaccccttccaggccttgctgtccatttttactccactgtcaccacatgttcaaattcttgctttctgctcgagtcagtactgctcacctcgttccaagagatctgggtctatgacactgtgggtgacaccctctgagcatcttttccgagctgtctgtgggtacctgaacctgccccccaacctggcccttgccctacctgccccgacctcagcgagtctggcccagtctgtccctgcttctcccctctggccccaagtgttctcaaatatgcccccgcctgcctgtctgtcactgcagctggcccagccctcatcctctctcccatgaacctctgtggtggcctgctctccctggctcccctgtctccagtttatgttccacacaggtgccaaaatgtctgcaaaaaatggagatttaacatacactagcccttggcttaaaacctgtacatgcttctctgccacctgcaaatgacagtcccatttcctcagcaaacctctgcatgttgtgggaacttatggcttctcagcctcccactcggaacccacctctggtttatgctccagaacatgatgttgttggaccctcccctccacctcctccaggctgagttagcctctgtctcccctcctgccctgggcatggctcttccagtagacacccccacatcacagtctaactctgtgtccacattccctgcaactgctgagctcctggagccaggccctgggaaccttgttcctgtttttgttcccagagccaaatagatatttgatgtatgattgttgaatgcagcagtgagtgaataaagacatgaatggttaactgaaaacattttatcaaaactgttatttgtcatcagagcatgggccggtttccaacagctaacatttaggagtgaccatttgccaggcactgttctaagccctttgcatgtggccattcatttcacccacatagcgccatcaatgacatgctgtcactgcattgcttgtcaaaagggggaactgaggcacggaggctgagcttttactcaacatgccatctatgttgagggacttctgacttggatagccgttcaactgcgagcactatggaggccagtcaggcctggccctgccttggaatttctgtgttattcagggacataatggggtttgtgttgatttttgttgggagtgtgtgggttaatctaggtgcaaccctcacctccttcccttctgatgtcctcactcccattggtcatgtgacccttaacgcccatcccaagctcagtgccaattccttgccccagggtcctggggattgacatggatcccaaaagcccgctgctgagaggacagggccactcccacccccctgactgtttcccagagcagctctggggcagaagtaaacttggacccagggggcataaccctttgcccttttatagtctattagaggaggatgaggtctgacatcagctggttcattgccccttgtgccccttgagcacactggggcccagggagagtcacatccctgccttgtggtacaggccaccggccctggacctgtgattaaacattgtccacaattaatttggaattattatctcgtgatacactccataaagttcagtcacacatcttctttttcttctcccctgcctaatgatcagacaagccaggtcttgtgactaaatgaaccgacagctggcagtgttcatctgattttgcaatgcccttattttgttgttgataaactaatgcaaatagctggttggcctggaactggtgattgggaaacattttaacccttctttccttcctctctatcctaaagacttaaaacacacttcacgcagtcacagaaagagctcatagaccagactgcggggcttcaaagccttctatcttatttaatcatctgtaaatagtttaaaggtaaatatggtaataatactagtattctagactattttgggaagccagctgatgtgaataaagggtcagagttaaaagatattgaaggaatgcagttttactgctctgaggtaggtttcaaggcttgagccaggcttagagatctttgtcctgatactggggataaagtgaagagaatatgaatgggtatgtctcgcatggttagaaaatctttttttttcctgtatttgtttaaaaagcattttgtaacttaaaaaaatacctatacaccttttttttttttgagatggagtctcactctgtcactcaggctggagtgcagtggcaccatcttggctcactgcaacccccgcctcctgggttcaagcaattctcccacctcagcctccccagtggctgggattacaggcatgcaccaccacacccagctaatttttgtactttttggtagagatggagtttcatcatgttggccaggcttgtcttgaagtcctggcctcaagtgatctgcctgccttgggctcccaaagtactgggattacaggggtaaaccaccacacctgaccataatacatcttaaatagaacattttccagctaatatttaaatgactgcatgtcattagaatctgaatgagtgttgtgttaaaatattttgtgttttcatatttatttacttacttatagctacggataagaatataggcaaatttaatctcccgtaaaaattaaaaggcagatgttttcaaagcacagaattacatggtctactctagacattgctcctaaggttgagcagaggggataagagctttttctcttttttcctttcctctttttttcatacaaagttcgttgtagatattttagaaagtatagaaagccccgacaaggggaaacccactcaacccaattttaatgttgttgtcatttcttttagtttttttgggtgcatttctatgtagctatatcctattgtacaagcaatttaggatcttgcaatataaaatgaaggcatgacctttgagctggccaaaagtatgggctgatttttgcaaatgggtcctggcagcaggggacataagtggggaaccaatccccacacaagcagaggtgagctggcttaggggcgagtgcatagctgactttggatgtagactagatttggggaaatttaaatggggtccaagactggaaatgtgtaatgggacagaaggtagaaatgtttaaaatcttaagttgttgagtttgttctcaattttgtgaaaactctttatccctttttgttccccaccccattttctaaccagaagtcaaatatgacaacattcatgatgtagaaaaaccagttcatcagtgtgacttgtgggtgagggtggggacagggccggtgttggtatatttagttttagagatttgctggaaaagtaacatttttgcttttgtctttctttcgttcctccatttctccagaagaatatgaaagtgttactcagacttatttgtttcatagctctactgatttcttctctggaggctggtaagttaagtatttctttgtgttcttgtctgctaagaaaatctgttatttagaatacatgaagtaccttccctaacagagtcatttctcatactcgtctctgttgaatctctgggcacagagcctcctggtcatagacctgtactgctggaagttcctctcagcatcttcgtctcattctctcccatatagagtgggaaactgaggcctagtgaggctgagagcccaaggtcatgtagctagttttggaacaaaagctaaaatctaggtctccaatctaggtccaggcctctttccacttggctgctggttgaaagtgtgatatgggaaattctgactttcatttggaggagatattatgtatagtctttatgaacccacagctggaagtcatcaagatacactactttttctgtttctttccatttcttcattttctctaatcttttctctttttgccaggtgctagctactggggatacagcagggaacagtgcacacagaaatacctgcctgcatagggtttatattcttgtagaagagagagataacagataagtagacatatattgtgtcatatgatggcaagtatagggaggaaaaaagagtataaggttttggcattacagtgggcagaaggttaattttttgaatgtggccagaaaaaaacctccctgagaagctgacttttgagttgaccttaaggaaggggaaaagagagctatttggatatcagattggggtgtggaaatattccagtcagcatgtgcaaaggcccagaggccaagagtatttggcaggctttcagaataaaaatatcagcatgtctggagcatagtgagagatgagggaagtcataagggaccaggctgtctgggtaatggggggatggcagagggttgattatatggaatgttgtgcccttttttagggtcttggcttgtagtctggctgggatgggaagacttcagggttctttgtttaagaccagagaggtgatctgacttacgttttgattcctgttttgagaatagatccgagggagccaaagagagaaatagagaagccagtgaagaggcaagccatgatgatggctttctctaggcaagaaatgttgatggcttgtcaaagggtggcaaggagaagtgagaagtagacaaattttgaaatattttgggaacagaaccaagagggatttggagttgggtcagatgtgagatgtgagggaaagagaagaatcaagaattatctcagggaattttggcctgcgcaaacgcaaggtgaaattgccattgatgagatggggaagatcaggttttcagactggatgtgttaagtttagctgtccattagatgtttaaaaggtgactttgactaggcagtctacagcctgagggaaaggtctgggttgaatatataaaattggagacctcagcaagcggctggtatgagaaccatgagactgaatgggatcatggagtgtagttaggaaagataagaactttaaggactgagccagagattgacttaaattccttggtccagtgagttttctcccctttgctgaggggctccatgtgtgttggagcataccttcaacattaaggctgtttaaggccttagccttcacttcctgcttgtgtatgacctcagagtcatccagaaatgagagcctggtgccttctatgcaatttcctgggcatgcacacagccctgcatacatgcccacccttctgggttccccaggaatgtgtcagagcttttcaaagccctctggaggttatggctctggtattgcagctttaggcagttgtaaaaaacaattaacactgagtttttccagcaaacgccttggggatagtgcttttgctgtggagctcttggtgaggtcaataacaccaccaccctatgaatgtgactttgaggacctgccagtcaagtcaaagagtggcagtgctctggaaatgggacttttcgaggagctccaaaccctctctcttcttgcaagcctgctggttttcaaagcctttgtgtctgcaaagctcttgatattcatggctgttttagagctgggaagagtaggatggaagtcatttaagttataaagctacaaaccctgctgatccgtgatttggcatgtttctgtttgtttccttattttctagtaaatgctcttctggttactgcaagcctttgatttttgaaattttttgccagtctttttgttgcctttatggaggaatgatttatgagacccccactccaccatattggaaatcttgcaaattcaatttctttgaatagaaaatagtattaatagatatagggcaatccaggctatctacttcttctcaagggagctttaatagtctggaaaatttgctcatttcatttacgttattaaatttattggcataacattgtttataatattccctcactaccctttacaaattatttaaaaaagagatgtcatctcttttttttcctgattagtctggctaaagatttatcaattttattgattttgtgaaagaatctgcttttggtatctttgatttttcttcattgttcttctgttttctatttcattgatttcctctctgatccatattactattttcttcttacttctgttatattaattatgttttttattttctgtatcttaccatattttgacattctggaagatgtttcatatctagggagagactgctccaccaggggctaagcagttcctaggtgtgttgtggacagcttacagcttgcccttcatgtgagactgcttgacccaagatggtaccccactcacctccttatccaactctcacacacccaaaccaatgttaccccagcctcaatcaacacagggctaggtaccagagaactagggacagcctctatgcccaaagcctgcaaaaatggttcaaatgggccaatctgaaactgtttatgctgccctgccttgcctttcccatgggaaccccagtaaagatgctggcctaggctttccttttgtttctgcttctgcctcctaacccaatctggtgattctccctgtggttttgcgtggtatggcacaccccttctgtccgaaccactaagtaatacaaatctttcaattgcattagtctctgttttgtcactcagtcaccttcgtaaatgaagacccaggcatagaatctctgcttgctgcttactttggaattactttgttctttttctagtttcttaaggtagaagctcaagtcatcaatttgaaatttttaaaaaatatataggcatttaaggctagcagtttccctctaagtactgctttcattgaatgccataagttttgatatgttatgttttccttatcattcagatacaaatactttatattctttttgatttctttgactcatgagttatttaggagtatgttaattttcaaatatatagggattccttggatatctttctattattgatttctaatctaattccattgtcaccagagaataagttttgtctaatttgaatccttttaaatttactgagtcttgggttatggggaagaatatggaaaatttgctaagttttatgtgtgcactttaaaaagaatgtaatgttctactgttgttggttggaattttctgcaaatatcaattatgtcaaattggttgatagtgttgttcaaatcttctatgttgttactgattatccgtttaattttattgcttgttctatcggtccttgtgagtggggtttctctagtttcttgcagaaccagtttctctagttcttgcagttctgtcagtttttgcttcatgtattttgaagcactgttagcagctacataaacatttggtattattgtgttcctgttgattaatgacttctttatttttttaaaatttatttatttatttattcattcatttttgggacaaaagtctctctgtgtcacccaggctggagtgcagtggtgcgatctcggctcacagcaacctctgcctactgggttcaagtgattcttgtgcctcagcctcccaagtagctaggattatgggtgcccaccaccacacctggctgattttttttgtattttagtagaggtggagtttcaccatgttggccaggctggtctcaaactcctgacctcaggtgactcacccgcctcagccttgcaaagtgctgggattacaggcatgagccaccacgcctggctgacttctttatttttatgaaatgccccttttttcttgtaatatttttactgtaaaatctactttgataataatagtcactcaagctttaactaattaatttttattaaggtatagttgacaaaatcgtgtatatttacagtgtacaatgtgatgttttggtatatgtatacattgtgaaatggttaaccctagctaattaatcaaactttcttttcatgagtgttagcctggcaaatatttttcttttctttttaatctatttttacctttatttataaaatgtctgtatgtaggtgtatgtgtttatgttaggcaccacatagttgggcctttctttagccaatctgatcatttccgcctttcaatgagagtgtttagactatttgaaattttagtgtgattattcatatattagggtttaattctgggatcttgctatttgtttttctatttgtcccatcaattctgttatttttttctctttttttgctgccttttagattaattggcatttttaggattcattttattttgctttttggctttttagtcataactgtttgttgtgtatgtgtttttttaatgactgctctggggcttaaatagccatctctaagttatctctgtctgccttcaggtaacactatacagtttcacatatagtatacaaagttaagagtatatacccatttctcctttcttgaactttgccctattatttccatatatgttacttctttatttgttttaaactttatagcattttattattttttatttaaacactcagttttctttaaagagatttaaataataagaaagatgatcttataattacccatttttgttgctattcattcttttgcgtagattcattttcatcttataatattgtgctttttgaaggaattaaatatttcttgtaatgcaggtctactggtgatgacattttacagctttggcaaatctgaaaaagtcagtattttttcctaaattttaaatatattttcatgggatatggaattctaggtagactttttctttcagtactttaacgatattgttttgctctcttctggcttgtattgtttttggaaagaaagctgcatcattttttgtctttgtcctctgcaataattgtgtcatttctcccgggctacatagaagattttatctttgtcactggttttaaacaattttattattatgtgtttgtagtttgctttatgtttcttttgcttggggttcattgtgatatgggggcctatgtatacatcatttttgtcacatcttgaaaaacttcaaatatgttttctgttttccacatttttcttcttcagtgattcatattacatgtattgaagttgtcctaagtaaaataattccctgcccattttattctgttatttttgtctctgtgcttaattttggataatttctaatgctgtgtcttcaagttcactcatctttttttttcctgcagtatcaaatctgccgtgaatcccatccattgttttttgtaactcaacattattgttttcatctctaaaagttttttaaaatctctttcatgtcttcactaatcatgtttgatctttcctgtagcatcttgaataaatggaatacaatagtaataaactattttaatttttaaatttattaggcctattgtctgtgtcatttctgggtcagttttgactgatcgatttttttcctccttatcgttggttgtatgttactgcttctttgcatgcctaattatttttttggatgttagacattgtggattttaccatgttgggtgctggatattttcgtattccccagaatgttcttgagctttgttctgccacatgattgttacttggaaatggtttaatcctttcgggtcttgcttttaagcttaattaggatcaggaaaaagtttattcttggcctaattttccctaatgactgagtcagaacccttctgggtactctgcctgatgccttatcattaatgaggctttccaccctggctgttgggaacagcaactgtttccagcattgggtgtgctccatgtgttactccctccagttcgtttggtagtcctccctctagccttgggtcattttcttatatgcttacactgactgatactcagctgaaaacttgggggagactctcagttatcccaagactctttctgcgtgtcgttatgcagctctaagtacttgggtactctgccctgcaaacttttctacccaggttctcagctccatctcctcaactcactgggctttgcctgtgttttttctcggcaatgtcatggcctagctgtaattttggacacctcctttcttctccgtctttctgggatttctctcctttgttttctgatgttcaatgtcttgaatactgttgtttcatatattttgtccattttttagttgttcatgtgggaaggtaaatccagtttctattactccatcttgtactgaaaggcatgtctctcctcctacattgtccccactttttagatgagtgaaaagggggtgaaggatgttaaataacttgccaggggtacagcacacaggcagtaagtgatgcagctggacttgaatatgcttctcagactccccagataatgatcttatcacaaggctgtaaagcttttatatgtaatgtgaattgatgtatttaataatcaatgtgtttcttcgtagatattaaatcaagacacactggcagatttttatgtaaattgcttccacccttcttccttttaaagataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaaggtaagagaggaattagtatgttacaaacatgttctagtttcctgcagttgttaaggacagaaatacttttaataatgcttaacttacctattttattttattttagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggtaattttattttaaatatgacatttcacttttccagaaaataaaatagttccctggacaatagaatgtatctgcaaagtacctttttattttgtatattgttttctctttaatggtgaaacttgatagggaacctaaaaagaattgtaagactgcattcacttaatttgaagcttaactagaaatttgtttgctgttgtttttatttaatttaataagatgtaattgagaaaagtactagaaatagatgtttaaagagaaggctgattataagcttaaggtattgaagatgtaactatttattacaaaacatactatgtgtgttttattgaagatatggtcttcaaataacctgctagtttccataactgtctgaaaagtgggttgactagctttccatggaacaccccatgttttggtaactttaatctacctagtctgatggaacttaaatggggaatcatcttgtagagcttaagacgtactaaatacgtaatatcaatgaagtgcagtattgttaagaaactatatagtgttaacatttttttcaaacatgtttttcttgcaaaataaattggccttcacttcatagtacaagtctcatagacttgaaaacttaatgtcataggaatatagttaactgtttccaaaaagccagtattaaaacttactatatgtaaggaacttttccagtcactttctaaaaatataacatttgctaaggtgaaaaaaatggagctcctttggcggtagattggggaaagttattggttattggttttcaatgcttctctctccctttatctaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctaggtgagtcatagctccagccctaaaaggtttagatctgggaaggtccagagactgtgattctaatactactttcattatccatgaagaaaccaaatccaagacgacctcaatgataccacaaaagtcacatggctttagttttgtttttttgttactaaatactatgtaatgtttttccattcctgcttcagatgtagttctaattaaatagagacattatgagctgtgttttccaactgatttaagagggttgttctttggcatggctaaaaatggttcttactgaaagctctggggctccctctggctggtatatgggaatgttctgagagcctgcacctggggaatctcagtgagtgtcagtgtctagcagcaagcatcggtgtggacactaatgagctttggaataagtcacatttccagaatctacctcctgttcattctgtgttaggtgttaacctctctaaccctgtttcctcttctgtaacaagatgatgcaatctcccaaggttattgggaagattagagatatggggtacacgaaacttgtgtacctggtgcaaagaaatgcttggtgcaaaacagctatgcaattaataggtgtaggatgattgttcttgttaattttcttgtgtctttcaattctgcgttaaccatgtttcatattgaaaactatatcacagcaaaatgaaacaaaatgcacaaattgccaggggatagtcagaatgctcaaactttttgtaaatattgagattttgtaagatttatgtaataaaataagagttattccaatcagaacttttttgcaggttataggggtgactattagtagttatgctgggacaacaggtataaattgggactatcccaagcaaactcagaatatgatcaccctataaatagcttcacttttccagttatataatactttattttcctaaaaatatttttattaaataaaagttaattccttgccatggtcccacaggcatcagtgaatcccaattttcaatggtctttgtatcaaaccatgttcttgagtttttagcagcctgtcattgggtagctctggtctgtctttcctgaaacatagtaacctaaccagcaagtagaacttgagagagaactgggcactggggactatttaagctaggttaagtgtttttttttttttttttttttttgagatggagtctcgctctgtcacccaggctggagtgcagtggtgcgatctccgctcactgcaagctctgcctcccgggttcatgccattcttctgcctcagcctcccgagtagctggaactacaggcgcccgccaccacgcccggctaatttttttgtatttttagtagagatggggtttcaccgtgttagccaggatggtctcgatctcctgacctcgtgatccgcccacctctgcctccttaagtgctgggattacaggtgtgagccaccgcgcccggccaggttaagtgtgtttttgatattctctgtttccttttctgatcccatttgtagaaacaatatactctactcggagtgaggtaatattttgttttctttccaaggcccacaccaatgatgcctagcactttttgttcactcaaggattcaaaaatatttattgagcatttactatgtttcaggaactgtaataggtatacattagggaaaaaaacagagaatatcctaccttcatggtgttcactttttttttgattgggggaataccgagtgctcaattttatagtttctcatagtttcttcatggccacagataaacccctgaaaccaatcttttcataaataagtcagattaatttctggggcttcttgatacttttttgcctattttaataaattacagcattattccataaccctgtagttctcactattgggtcattaacacagtcattaaatgcaagcaggtctagtattgactagcccttctggccaataacacccaattcaaggaagtgactttccactactctcgcctttgctgacatgctttcacttaagagaggcatttgtctggggacccagggtcctggtgatgtgtgtgtttttcagtagcaccccactctatgaattcggaaggtctagctctaccccgggattcacagtgtgctgtggcctctgcctcagctttcttccttcactttctgcctcctgtctcctggcatatgtgctttgaacacttgatggaatatctggccagaagtcatttagtatgttttgctaagtgttgtcgtcacttgagattctgatctataagagactgacaaaccttatggatgtttttctttcagaggaaaacaaacccacaaggcctgtgattgtgagcccagctaatgagacaatggaagtagacttgggtaagtgggcttcagtgagggtatgctggaatcggttttttttttttaaaacataagagtaagataaattgtatctttactatatataatctaagccatttactgtataaatctatcaatggagggaaagtgagacaaattatatcttaattttttgtatttcttgcctctatggcaaacatcttgccatgtctgatatctccagccctacttttctgtgaacacttattaccatgaaaacaccaaccagacaccaaggtcaaaaggcctaggaaccagcaatgccattgactggtacaggattggatttctttctttttttttttttcacagagttaaaatatttaatgacaaaaatagggtttgctgtaaaagtgaatcaatacagtaggtgttacttatctctgaattaaacaaaaattatatttgacatcttaaagaacttctgaagaattgatcattgtacgacagacatcagcagtgttacaatttcaggactggatttctcatgaccagatccaagctttgagtcggaagagtaaggctacaggccccaaagatggtagtcattctagaaaagtatttttccaagttagtgaacattttttattcaagagtaaagaaagaaccccacaagcatctagctctgcactgtttagtgcagtagttactaggcgcatggagttatggacatgtacaattaaattaagtcaattgattcatttagttaaattaaaaattagttcctctgtcacattagccatatttcaagggcttaatagccacatgtgacaagtgactactgtacagacaagcacaaatatagaacatttccaacatcactgaaagttctattggaaaccactgatcaagagagaaaaagtggttctttgtgtcagaggacccaaaataggttggccttggaattgtcctctgtaatagtaactgcatgacagcagtcaagaaccatacagaggttagaaggtatatgcttgtgatctgtgaattctgtacttggccaattctgtacttgttatttatggtggaaggtggtagaaagacattcttagacagaaacaaaaatgtcaaaactcaaaattaaatatgggccaataggctctagaacaatgtttctcaaccatctttttttgttttaaattgttcccctttagagtctaaaaagtcttcttccacctaattctctttcctgtctttaaatttcagtaccacagttatcttttatatttgctgatatactgtggccctttggagtaccacaaaccatgtaatatctaaggttttcttgcctcttccccaagaaccagtttttgccctgctggccacagcccctgttgaaaatgcctgccctagaagtgtgtaattgagagctctgatgcctaggctgcattgatctctcaatctacaaaaaaaagcttcaaattaggaaataattattttaatgtattatattgacagtggatcagaagcatatagtaccctgtcataggattatcctgaagggtgttaaacaggcaataagatccaataccattactcctaaaatgacttagaaaaatagggattgagagatatttccttaacttaataaataacatcagtgcaagccaatagtcactaatattcttcatggtgaaatactatagaccttctcactaaagccaagagcaagacaaagatgcccatgtaaccactattactgagcacagtctagaagtgcctactaatgcaattgaaggaaaaaaacaaggtatgcttaccacaagggaaaaaagacatttttattattgtttcctgatcataccaatcccaagaaaattcccgggaaaaactagaattaattctgtataaattagtcagataataaattaacatttagaattaatgttctaaaatataagacttgtttagcaataaccagctagaaaacataataggaaacaaatgccatttgcaccagtaaatgtcttagaagtgtccataaaatatgttagaaaaactttgaaaatatgtggaatttataagagaggaaaaaactaaaaaaaccaaaaccctgaatattaatctcagaaaaactgaaatttaaagcatgcatccagccaggcgtggtggctcaagcctgtaattccagcactttggtaggccaaggtggacagatcacttgaggccaggtgtttgagaccagcctggccaagatgttgaaacaccatctctactaaaaatacaaaaattagctgggtgtggtggtgcacacctgtagttccagctgctcaagaggctgaggcatgagagtcacttgaacccaggaggagaaggttacagtgagccgagattgtgccactgcacttccagcctgagtgacagagcgagactgtgtctcatttttaaaaatggaattaaataatggatagagggataacagtttttaaaaaggaaggccgatgagcaccaagctaatgaaaagcatgttgattcaccgtgaattcaagaaatgtagatgaaaacttaagtgacattttcttctctcaaaaggcaatgtctaaccaaaaacacttgttatctggtggttttggggaaaatcgtgctcacatacactattggagagagggtagactgacacagcctcactaaagagagggggttagcttttaaaatatgtttctttaattcaatcttgcttctagattttaatacttcaggatgtgtacaaataaggctattcattaaaatattaatcataatagtgaaaaattaggaaattgtgttcatcaataggaaatagttaatcatagtgtatatgtattatggaatgctaagcagccatgacagagtctattttggaagacaaatcatgtgggcccaaattcccaatccacagtaattacaaaatagtaggcaaaaagaccccatttcaaaaactgcacatgttcacagagaagataaggaatgagacgcataaggttactaatggtggttttctctgggtggtgggtttagggtaattttcctttttctttgtgcatttctatatctaaaattttaattcaatagccatttattaatctagatagatcagaaaaaatcaattaatgttaagattaaaaatacattctttgcaggatcccagatacaattgatctgtaatgtcaccggccagttgagtgacattgcttactggaagtggaatgggtcagtaattgatgaagatgacccagtgctaggggaagactattacaggtatgtatgctaagagttattcacattttggtgttaaatcccacgtgatattttatataaccttgtcggttcagtttaaaagcaagtgttagttgctcctaacctttgctgcctttttttttttttttttttttttttgctaagctaagtagaatttataagatcttgtacatttaaggtaaaaaatacttgtcattgtggtgcaaattacagaccacttagaagcctttctcttacgttatacatgttgcaacatttcaacgaagcaattatctttcattattcttcatattcctcaagtagcttagaagagactcattaatgagctcaagaatcaggcaatccactgctctcgaaagcctctactggtttcctactgctcatctatgggacaaggatctcctggcttcccatgacctctccttcacaacacctgcaaagcactttgtcatctgccccaatctcctcttgtttagtgtctcctctgtgccccatggagaacacaatgcatttgtctacatttttcttcttggaagtggtaatttttttgctttctctgctactgagcctgttactgacagtggtcttggggttataaaatctcagattagtgttgccagcagtctgaatgttgtgactgtgattgggcagggtgattatttcagtggcaattttgtcacaaataaggaaatacacagggtatacaggtcttatttgtagttgatgcaattaacttacacaagtttatttactctctctctcgaatagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccaggtaaacaacaaactaattgaaatgcagttttgttttactgtagtaagattccatgactttgaagtttgaaatgccatttcctctgcttagaacacgcttcacttcctcattacttgggtaacttctatttctcttttactcttctgctgaactctctcttcttggaagcttttctgtcctgctgcctgcccttaacccagctctcggcccaaagagaggaggttagggcctctgtatgtacttctgtagcaccatatgtcacaggatctatggtacttcgttttctgtacttaactataaattctgtgatggtggcaaccatttatcttagtaatcattctatttccacagctaatggcaagttaggtctggtacattgtgggtacccaatgaactacattgatgatgcatagggtaagactaaatatccactttcaaagaggacatcagaagtcactgggtttcatgaattggtataataaaacataatattgaaagtatttgtgaaacattttaaggtaatttgtggtttaattaaacataggctattataattgcgtgcatggaagaatatctgaaagactctataaattaacttctatgtatgtttaaatactggcagcatacaaatagaaattacatttaaaagataacatttatggtagcatcaaaaatcatcaaatacttaagaataaatctagcaaaagctgttcaaaacctctgtaatacaaactaaaaaatattgagataaattagagaagaactaaatggaaggatatacaatgttcatagattgaaagactcgatattatgaagatatcagttcttccccaaatgaatctatggattccaaaaaatttcaatcaaaatctcagcagtatttgtacaagtgagagtcagtgtttgtatgggtgtgtttttgtggacacctgtaaaagtcatagggaactgtaaaggaccaagtatagtcatggtggtcttaaataagaaaaataaatctggaggattattactacagacatcatgatcttgtatgaagcgacagtacttaagaccgtaagtgtgaactatcatttgggccagctggatatttgtctggaaaatggtataacttgatttctgttttatatccaaatcatttaaattggaaaagtaaataaagcttttagattcccttttctggatgcttttacatggttcctgatatttagagggtactttctttttcttccctctttcttcttctctagccccctccccatcacctactccatctgctccccagcttcctctttaattattggataactaagtagagaaggaggccaggagaatgtggaaatgtgaaacttccctaagcctccaccttattcgctttccaccagtctttaactttacccaatggactctctgacctcagggaacttttgtaggcttttgagtgattttaacttttccctgttttactgtggaatgctctatcctgtggtcttcggtattatttcccatgttattgtatattatgctatttaggtagaaacttcatagaatgcaccttagttttatcattgctttgtacattagtatccattacaaagtgataataatgaatgagttaatattgtctgaatgcaggccattcccagatatgggctctctgagacgaagatatttaatttgctgtgctcaaagttttaattctttttggttctaatattttttctcctttttttttctttttgctatagtcactaatttccagaagcacatgattggtatatgtgtcacgttgacagtcataattgtgtgttctgttttcatctataaaatcttcaagattgacattgtgctttggtacagggattcctgctatgattttctcccaataaaaggtataattttgtattccatgcagtatttcttgttggagataagggatagttaggagatgtagaagatgactaagagggtttttactaagagggtttctaaaatgaaaagtggcatatacaagaatactagttattcttacacagaattatagttttagaactcattaggctgaatatcattgttttctaagttcctgcctcaacattcatattggtagaataaacaggtatttagagcatctgtttataaattcagttatgcacaagccattggtaggccttgctctgtgatgaataggacagacagagatcataccttaatgaaagaaatgaaatgactagatcttcatgcatcagggaggttctctctctcctttgtttaaactttgcgaaaaaaaaaaaaggaataccacaatatctaaaaaaaaatgaatggatagaattcagggctgagacctctggggaagaagatgaggacagggagactttaaggatggctctatactaagagtatacgaggcagcctccaaatagaagaacaaatttgcagtaaaacacaagaaatagaaaccttgtaagagatgaacactttttaaagggattatatttttggtattgctgcttcagtcatgccattgtataaaaaaagatgaatagttcattatgtaatgaatgtttgtgatactgactttatcaaatctcttatttttgccttgtggttctaaatacattatgtttttcctttagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaaggtatgtgtgtaatggaacagagtaaaggcttattgttgtaaaactacttagtaaaatgtggattccatctttctagaagatcgtggcataggggtatatgtttcacaattttaagaacctcttcagaagtgtatgatgatttttacatttattaaatgcatttacttctctcatattttgtcagagcaataattaagtgattttcatttagttttgaaaaacttaatgactagttaaacccaacagttgctttacaactgatacaattaaacaggagtggtagagatcaaatgattgaataataagtttttaaaattccaacaaagttttctgagttctaaatgaaatatttgtcttttgagggccaatttttgagttagtctataaaatgggaggtttgcagtggctcatgccttttatctcagtacaaccctgggaggccagggtgagagggtcacttgagcctaggagtttgaggctgcagtgatccaagatcacgccactgcgctccagtgtgagcaacagaacaagagactgtctcttaaaattaattaattaaaaacatgggaaactcctttaattttaagtaagacaagaaaaaggcattaggagccatacggttgtgaaaagccttgtgtggctttggttcaggagagaatgatgataaatagaattttacttactatattgtgcttcctgtttttcagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcatggagaagttgccaagagttctttaggtgcctcctgtcttatggcgttgcaggccaggttatgcctcatgctgacttgcagagttcatggaatgtaactatatcatcctttatccctgaggtcacctggaatcagattattaagggaataagccatgacgtcaatagcagcccagggcacttcagagtagagggcttgggaagatcttttaaaaaggcagtaggcccggtgtggtggctcacgcctataatcccagcactttgggaggctgaagtgggtggatcaccagaggtcaggagttcgagaccagcccagccaacatggcaaaaccccatctctactaaaaatacaaaaatgagctaggcatggtggcacacgcctgtaatcccagctacacctgaggctgaggcaggagaattgcttgaaccggggagacggaggttgcagtgagccgagtttgggccactgcactctagcctggcaacagagcaagactccgtctcaaaaaaagggcaataaatgccctctctgaatgtttgaactgccaagaaaaggcatggagacagcgaactagaagaaagggcaagaaggaaatagccaccgtctacagatggcttagttaagtcatccacagcccaagggcggggctatgccttgtctggggaccctgtagagtcactgaccctggagcggctctcctgagaggtgctgcaggcaaagtgagactgacacctcactgaggaagggagacatattcttggagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctggcatgaccatcctgtcctttgttattatcctgcattttacgtctttggaggaacagctccctagtggcttcctccgtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctcttgcctgcacccttcctcctcctttgcctaggaggccttctcgcattttctctagctgatcagaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacatagatttatgtaatgctttatgtttaaaaacattccccaattatcttatttaatttttgcaattattctaattttatatatagagaaagtgacctattttttaaaaaaatcacactctaagttctattgaacctaggacttgagcctccatttctggcttctagtctggtgttctgagtacttgatttcaggtcaataacggtcccccctcactccacactggcacgtttgtgagaagaaatgacattttgctaggaagtgaccgagtctaggaatgcttttattcaagacaccaaattccaaacttctaaatgttggaattttcaaaaattgtgtttagattttatgaaaaactcttctactttcatctattctttccctagaggcaaacatttcttaaaatgtttcattttcattaaaaatgaaagccaaatttatatgccaccgattgcaggacacaagcacagttttaagagttgtatgaacatggagaggacttttggtttttatatttctcgtatttaatatgggtgaacaccaacttttatttggaataataattttcctcctaaacaaaaacacattgagtttaagtctctgactcttgcctttccacctgctttctcctgggcccgctttgcctgcttgaaggaacagtgctgttctggagctgctgttccaacagacagggcctagctttcatttgacacacagactacagccagaagcccatggagcagggatgtcacgtcttgaaaagcctattagatgttttacaaatttaattttgcagattattttagtctgtcatccagaaaatgtgtcagcatgcatagtgctaagaaagcaagccaatttggaaacttaggttagtgacaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcatttttttaaagatgccctaagtgttgaagaagagtttgcaaatgcaacaaaatatttaattaccggttgttaaaactggtttagcacaatttatattttccctctcttgcctttcttatttgcaataaaaggtattgagccattttttaaatgacatttttgataaattatgtttgtactagttgatgaaggagttttttttaacctgtttatataattttgcagcagaagccaaattttttgtatattaaagcaccaaattcatgtacagcatgcatcacggatcaatagactgtacttattttccaataaaattttcaaactttgtactgtta

SEQ ID NO: 35 - DNA, 15775 bp, Homo sapiens
caagcttagcctggccgggaaacgggaggcgtggaggccgggagcagcccccggggtcatcgccctgccaccgccgcccgattgctttagcttggaaattccggagctgaagcggccagcgagggaggatgaccctctcggcccgggcaccctgtcagtccggaaataactgcagcatttgttccggaggggaaggcgcgaggtttccgggaaagcagcaccgccccttggcccccaggtggctagcgctataaaggatcacgcgccccagtcgacgctgagctcctctgctactcagagttgcaacctcagcctcgctatggctcccagcagcccccggcccgcgctgcccgcactcctggtcctgctcggggctctgttcccaggtgagtcggggtggggattgccgtcgggccagttctccgaagccccgggaggaccggctcccgggtcaggtcatgcatgcttaggtagctgtttatgggaaggaggggctagagacagcgattgaaaggcaacagccagtaggttcgaatccagaccctgcatacctccacgtgtggccttgggctatagattgcagctttaaaaaagggtagggggttggagatggaggggaggggcgggcctcgttttgttgcccaggccggtcttgaactccgggggtctagccttacctcctgcctcagcctcccgagtagctgggatgagaggtgtgaaccaccgccttgcttggctagattgcgtctcttacagtttctcagctgtaaaacgggaaacgttatagcggccacctggcagggtatcttggcccagcgcagcacctggccccaggactcgatcatgatggtttgggaacttggctctgtgccaacccaacaaggcttaagggacccccacccccctcaagatgtatattctgttcctcatcctctctgcccctggggaagtccagggctgcttctacttgggggaattccagagctgacttatccgtggcccaaagctgagaagtgggacgccccagcacaccctcccccagctccagcccagctagggaagagggaaggggtcagagggtctttcatggtggtgtaagtttggggaaccaggagggtgggagattgacagcttggttaacagctcaacaaagcctgagatccaggccagcacggtagttcatgccagtaatcccaacactttaggagccccaggcgggcgaatcacttaaggtcaggagtttgagaccagcctggccaacatggcaacatcccgtctctactaaaaatacaaaaattagctggcatggtggtgggcgcctgtgatcccagctgctcgggaggctgagggaggaaaatcccttaagcccacgaggctgaggttgcagtgaaccaagattgtgccactgcactccagcctgggagacatagcgagattctgtctcaaaaaacaaagcgttctgatccggactcagacccagatcgcactgctttctagctgagtaaccatttctctctatgaaatgggaatggtcccagaatctcccttggagaatgtatggagccagtgtcctcacacccccatccaagatagaacaaatctgagacaggaatctttgagtgaggcagtgctgggctcagacattttttcccaccttcggaggcagcagaatctgagggacctgatccaaataagccccttctttctttcttttcttttcttttttttttttttttttttttgagacggagtctcactctgtcgcccaggctggagtgcagtggcgtgatctcggctcactgcaacctctgcctcccaggttcaaacgattctcctgcctcagcctccctgagtagctgggactacaggcatgtgccatcacacccggctaatcactgtgttagccaggatggtctcgatttcctgacctcatgatctgcccaccctgcctcccaaagtgctgggattacatgcgtgagccacagtgcccaccccgtaagccccttctttcttacctgcaaggtagccagttgctacccatcctgtgctgagttacttgtattagcaagggatggggtggctatactcacccaccttacagatggggaaattgaggcccaaagagggggaaactacgtgtctcagggagtgaggagccagtctgattcctggagggctgactgtctccacctgacttcttaggagggaggagggcaccaacttcacattaaaatctggttggacacagtggctcacacctgtaatcctggcattttgggaggcttaggcgggaggatcacttgaggccaggagtttgagaccagccttagcaacatagtgagaccccatctctacaaaaatgtttttcagggccaggcgcggtggctcacacctataatcccagcactttgggaggctgaggcgggcggattacctgaggtcaggagtttgagaccagcctgaccaacatggagaaaccccgtctctactaaaagtacaaaattacccgggcgtggtggcgcatgcctgtaatcccagctactcgggaggctgaggcaggagaatcgcttgaacctgggaggcggaggttgcggtgaactgagatcgtgccattgcactccagcctgggcaacaagagctaaactccgtctcaaaaaaaaaaaaatgtttttcaaatattagccgggtatggtggtgtcctgtagtcccagctacttgggaggctgagatgggaggatcacttgagcccaggagttcaaggttacagtgagctatgattgtgccactgtattccagcctgggtaacagagggagacccgtttaaaaaaaaaaaagtgatggctaaagtccttccatggctccctattgccctcagtataaagaacacatgtggctgggcgtggtggttcacgcctgtaatcccagcactttgggaggctgaggcgggcggatcacttgaggccaggagtttgagagcaggctggccgacgtggcgaaaccccgtctctattaaaaatacaaaaattagctgggcgtggtggtgcttgcctgtaatcccagatactctggaggctgaggcaggagaatcacttgaacccgggaggcaaaggttgcagtgagctgagattgcgccactgcactccagtctgagtgacaaagcgagactccatctcaaaaaaaaaaaaaataaaagaacacatctttagcatggccttcagtgctcacgggatcttcctgaattaatctccccctcttcatccttgctcactcagctccagccaccctgccccgggacatctgtacttgcctggaacttatttcccttttctccggacagccagccctttctcgtcatttagatctctgctgaaacattaccctgtcaccaaagcactgtctattctatcaccctgttttgtttttgtcaaagctcatattaacatcagttattaattatcttgtttgctcataatttttttttttttttttttggagacagagtctcgttctgttgctcaggctggagtgcagtggcacaatcttggctcactgtaacctccacctcccaggttcaagtgattcttgtgcctcagcctcccaaatagctaggactacaggcacgtcccaccatgcccagctaatttttgtatttttagtggagacggggctttgtcatgttggccaggctgatctcaaattcctgacctcaagtgatctgcccgccttggcctcccaaagtgctgggattacaggcgtgagccaccacacccggcctgctcatgaattttctctttaacttccacatcgaaggcaaagtattgtcttgttaaggctgtgcctccagcacccagcacaggctgggcgcacattcccttgatgaacctgatttgtaatgcctgtcgcctcttccctcgtttcttctaggacctggcaatgcccagacatctgtgtccccctcaaaagtcatcctgccccggggaggctccgtgctggtgacatgcagcacctcctgtgaccagcccaagttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactgtgagtaactgagcccggagggctggactaggcagacccggtgggagagacgtgcaggggcacctgcagaggcctgggggaatctttgccacttgctcgtagggtcaaggaggggctccttgcagggcaggtggggacatccttggaaagtccctttgtgaatttctttgggtacaattaaagtatttacaggctgggtgcggtggctcatgcctgtaatcccagcactttgagaggctgaggctggcggatcacctgagatcaggagtttaagtttcgccaacatggcgaaaccctgtctctgctgaaaatacaaaaatcagccgggcatggtgtcaagcgcctgtaatcccagctacttggaaggctgaggcaggagaacgcttgaacctgagaggcagagattgcagtgagccgcgatcgtgccagtgcactccagtctggataacagagcaagattccatctcaagaaaaaaaaaatgccatctctctatgcctcactctttgaacatatgacacggtcctgcttcagacactttaataaaagatgcaaattaagccaagtgtggtggcttgtacctataatcccaactactccagaggctgaggcagaaggatggtttgagcccaggagtttgagaccagcctgggcaacagagtgagaccctgtttctttcttttttttttttttttttttgagacggagtctcactctgtcgcccaggctggagtgcagtggtgtgatctcggctcactgcaagctccgcctcccgggttcacgccattctcctgcctcagcctcccgagtagctgggactacaggcgcctgccaccatgcccggctcatttttttgtatttttagtagagacggggtttcactgtgttagccaggatggtctcaatctcctgacctagtggtccgcccgcctcggcctcccaaagtgctgggattacaggtgtaagccactgtgcccatccaagaccctgtttctaccggaaaaaaaaagtaaataatttagctgggcatcgtggtgtgcacctgtaatcccagctgctcctgaggctgtgatgggaggattgctttaacccaggggttcgaatcctaggagttcgaatccatcctaggcaacatagcaaaaccccatttttatttaaaaaaaaaaaaaaagatatgagttaaaactagccctgggatggcatttttcacatattggtaacaaacaaaagaattgatggccgggcgcagtggctcacgcctgtaatcccagcactttgggaggccgaggcgggcggatcacaaggtcaggagatcgagaccatcctggctaacatggtgaaaccccgtctctactaaaactacaaaaaattagccgggcatggtggcaggcgcctgtggtcccagctactcaggaggctgaggcaggagaatggcatgaacccgggaggcagagcttgcagtgagccaagatcgtgccactgcactccagcctgggcgacagagcaagactccatctcaaaaaaaaaaaaaaaaaaaagaattgataacagctgtgctgccaaggctattggaacgtaggaggtcctaggacagtgctgttgggagcataaataagcccaaccctgtggcgggaaattgggcatcagttctcaaaatgtcatgggctgggcacggtggctcacgcctgtaatcccagcactttgggaggctgagggaggcggatcacttgaggtcaggagttcgagaccagcctgaccaccatggagaaaccccgtctctattaaaaatacaaaaaaaactagccaggcatagtggcacatacctgtaatcccagctactcgggaggctgaggcaggagaatctcttgaaactgggaggcagaggttgcggtgagctgagattgcgccactgcactccagcttgggcaacaagagcaaaactccatctcaaaaaaaaaaaaaaaagaaataaaagaaggtatgttgaatatgagtggtatgccaccctcacattagggaagggcagtttcggggaggctgtatttatgtataaaatagccctaaaaggaagtgggagaaatgacaatattagctggctatgagaagagaggctgggaggctgtgggagagggcttgggtgtggagaattctttttgttttttcctttttttgagacagagtttcactcttgttgcccaggctggagtgcaatggcacgatctcagctcaccgcaaccttcacctcctgagtttaagtgattctccggcctcagcctcccgactagctgggattacaggcatgggccactacgcctggcaaattttgtatttttagtagagacagggtttctccatgttggtcaggctggtcttgaactctgacctcaggtgatccgcccgcctcggcctcccaaagtgctgggattacaacgtgagccactttgcctggctgagaattctttttttgttgttgtctttttgagatggagttttgctgtgtccccagcctggagtgcaatggtgtaatctcagctcactgcaacctctccctcccgggttcaagcaattctcctgcctcagcctcccaagtagctggaattacaggcgcccagcaccacgcccggctaatttttgtatttttagtagagacgggatttcatcatgttggccaggctggtcttgatctcctgaccttgtgatctgcccgcctcggcctcccaaagtgctgggattacaggcgtgagccactgcccccagccgagaatttctctttgcgtccttcctactttggggacttcgaatggtgggaaagagttatcaaggccaaaataaggaattcaaatgaaaacaaaacaaaatcaaagaagaaaaaacagaagagcactgggcaggctaggcacgtggctcatgcctataatcccagtgatttagaaggccgaagtagaaggatcgcttggaggccaggagttggacaccagcctgggcaacatagcaagaccccatatctacaaaaaataaaaaacctaaccaagcgtgctggcatactagtagtcccagctactcaggaggctgaggtgggaggatcacctgagcctgggaggtccaggctgtagtgagccgtgatgacaccactgcactccagcctgggtgacagagaaagaccctgtctctaaaaaataaaaactggccaagtagctttgggattagccttgggttccagtcccagcaaggcctttaatagcttgggacatgacttctgcatttactttgcaatcaggtgagacctcctctgatggggaaaatgacacggtgagtgacaaaggatgttctcctatcattgtgtcagggcaaggaagcctctgggtaaatgatcaaatgatcagctttgcttctgatttggagggtgggtgagcagatgctgaccttcccaggtgagggaagtccccgaacattcccagcagcttctggaaaccccagggaaacctctttgaaggtcttttctgcatctctgcctgataggtctttttttttttttttttttttttcttttttttgacacacagtcttgctctgtcgcccaggctggatcactgcaacctccatctcccgggttcaagcagttctcctgcctcatcctctccagtagctgggattacaggcacctggcaccacgcctggctaatttttgtatttttagtagagacagggtttcgccaagttggccaggctggtctcgaactctagacctctggtgatccacccgcctcagcctcccgaagtgctgggattacaggcttgagccaccacgcgcggctctgcctgatagctgagagcatagaactccaggtttgagacctggctctgccacatttctccctctatgactgtgggtgccccactttgccttagtttttacctctgtgaaatggagcagatggctggcacaggtagcaaaggagtaaaagttatgtgggagggtggtacctgagagagactctagcttggtcttgccccacccctggtgtaaacataaagaagcctccctggatggctcaatcttctccaaaaaggttagaggtgtaattcctagaggaggcgaccactagctgggctttgaaggatgtgtaggagttcataaggacaggcattctgggcaggaggaacagcctgggcaaaagttgggagcagggagaaatcttgatggaggcaggaggaggaggaggtaggttggtgtaggccaggtgcagtggctcacacctgtaatcccagtgctttgggaggccaaagcaagaggattgtttgagcccaggagttcgagaccagcctgggcaacatagcgagaccctgtctctaagaaaaaataaaaaaattagggtacagtggcatatgcttgtattctcaactactctggaggctcaagtgggaggatcacttgaacccaggaatttttttgtttttgtttttgtttttttgagatggagtctcactctgtggcccaggctggagtgcagtggtgccatcttggctcactgcagcctcctccacctcctgggttcaaccgattctgctgcctgagcctcccgagttgctgggattaaggtgcccaccatcatgcccagctaatttttttgtatttttagtagagatagggtttaccatgttagccaggctggtcttgaacgcctgaccgcaagagatcctcctgcctcagtttcccaaagtgctgggattataggtgtgagccactgagcctggtcaagcccaggaatttgaggttacagtcagctatgattgcaccactgcattccagcccaggtgacagagagagacactgcccctaaaaaaaaaaaaaaaattgattgatgggaggaagggtgaggttggcagagccttgaatgccaggtggaggagctgggactttccttcttggggtgatagggagtcatggagggtttctgagcaggccagggattagatagctgaaggctggatttactggaagccaatgagcagttggctatggtccttgtccacgcggcccatgttgtgggcagtgaccgtattcaagaagggaaggacagacaagtatttgaatacttcagtgaccaggatttggtaaaggactgcaggtcagggtcaagaagaggtgagagcaggacagacttcctccccgctgcaccaggcagctgagctgggtttcctctaggggctgaggtttgagggtacctcaagttctgcaagagtctataggaggtggtaagagagaagagctggaggtcagagttttcttgactatatatatatatatttttttgtttttgtttttaacagcttaacagctttctgttttatttttagagacagggtctcagggtctcactttgtcacccaggctggagtgcagtggtacaatcgtagctgactgcagcctcaaactcccaggctcaagaaatcctcctcccacccttagcctcctgagtagcagggactacaggtgtgagccagcaggaagcccagctggttttttttttttctttggtgttttttgtttgtttgtttgagaccggagtttcgctcttattgcccaggctgaagtgcaatggcaggatcttagctcaccacaacctccgacccccaggatcaagctattctcttgcctcagccacctgagtagctgggattacaggcatgcgacaccacacaaggctaattttgtatttttagtaaagacagggtttctccatgttggtcaggctggtctcgaactcccaacctcagatgatccacctgcctcggcctcccaaagtgctgagattacaggcatgagccaccgtgcccggcctttttttttttttttttttttttgagacagagtctcactctgtcgcccaggcaggagtgcagtggttcgatctgggctcactgcaagctccgcctcccgggttcactccatcctcctgccttagcctcctgagtagctgggactacaggcgcccaccaccacgcctggctaattttttgtatttttagtagagacggggtttcaccgtgttagccaggatggtcttgatctcctgacctcgtgatccgcccgccttggcctcccaaagtgctgggattacaggcgtgagccaccatgtctggcctggccaggctggtcttgaactcctgacttccggtgatccatctgttctggcctcccaaagtgctgggattacaggcataagccaccacgccatgccgaagcccagcttgtttttaatttttttttttttttttggagaaatgaggtcttgcaatgttgcccaagctagccttgaactcctggcctcaaatgaccccgccttggcatcccaaagtactgggattacagatgtgagccaccatgccccagccttgctttcttgagatacgatttagaataccataagattcatcccttttaagcacataattcaatgacttctgtacaaacaaccatgactacaatctaattttaaaatatttcaatcactctaaaaaagaaacctcctgcttatgtacagcgactctgtctacctcttaagtgaattctcctacctttaatagccctattttacagttcaggaaactgaggttcagagagacaaagtcacttacccacagcaaagaagcaaggctgggtatcaaatgcaggacccccccggtcctgatgctttttttttttttttttttttcctctgagagagactctcactctgtcactcagtctagagtacagtggcgcgatctcagttcactgcaatctctgcctcctgggctgaagtaatcctttcctcacaagtaaacctcagcctctcaagtagctgggactacaggcacacaacaccacgcctggctaatttttgtatttttaggtagagacggggtttcactatattggccaggctggtcttgaactcctgacctcaggtgatccgcctgcctcggccccccaaagtgttgggattacaggcgtgagccaccacacgcagcctttttgttattagactctgtcattactgacttttttttttttttaatagaaacagggtctttctttcccaggctaaagtacagtggcatgatcacagttcactatagccttaaactcctgggctcaagtgatcctcctgcctcagcctcccaagtagcagggactacaggtgtgcaccaccacacccagttaaccattcattcattcattcattcatttattttgagatggagtctcgctctgtcacctaggctggagtgcagtggcacgatctcagctcactgcaacctccacctcccaggttcaagagattctcctgcctcagcctcccgagtagctgagactacaggcgtgcaccaccatgccagactaatttttgtatttttaatagagacggggtttcactctgttggtcaggcttatctcgaactcctgacttcgtggatccaccctccttggcctcccaaagtgctgggattaaaggcgtgagccaccgcgccctgccaacctttttttaatttttcttagagatgggggtctccctatgttgcccaggcttgtcttgaactcctggcctcaagtgaccctcttgccttggcctcacaaagtgctaggattacagcctgagccatcacacctggccaacaggtttttttttttgttttgttttgttttttaaagaatgtctaggccaggctcatttactttcacctgtaatcccagcactttgggaggccggggtgggcagatcacttgaggtcaggaattcgagaccagcctgggcaacatgctgaaaccccgtttctactaaaaatacaaaaattagctgggtgtggtgacacgtgcctgtaatcccagctactcaggaggttgaggcaggagaattgcttgaacccaggaggcagaggttgcagtgagccaagatcatgccatcaccctccagcctgggcgacagaaggagactcagtctaaaaacttaattaattaattaattaaaaataaaaatacaaaaattaacctggtgtggtggtgtgtgcctgtaatctaagctactcaggaggctgaggcaggagaatcccctgaatcccagaggcagaggttgcagtgagccaagatcgagccactgtttgcccagtctagtgcactgggctgctgaatttatttgaccagacacctagcaatagactttgaagttcttttccacttttcactctaagatgctgctgtcatgaataaggaatattttgatccccttcacaaacactcggggccctcttaccagttttcactgaagatcttgacattcctatctgcttaggtgtctgggcgtgtttgggggagatactgaagaggtagggctcccaggcaggtgcagttcgtctgttaggcaggcagcaaggtccacttcaccagacacccccacctctgttttcctgcagggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttggtgaggattgaagaagccagcagggagaaggtgggggtggggtatcctgcaatgcggtgcctgtggccacaggatcttttgagatgggtgtggccccggctaaggggtgcatgtgttctaggcgtatgtgacctaggctgctgagtggccctggaagaggatctcgcaggagggggaatgaaatgccccagagaagggcttcgggacgtccatccctgtctgctcacacctttcttctctccctagtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagtaagaaggggcaggggcggagtggggcttcttgggggtgtgacctgaacccggggcggggctcactgtgtgcctattccaggctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtgtgagtggggctgctggtcaatggcccctatcccccaaggcccaatctccctgaaggtcccataaggtcttgcctccaagtcctgcccccacccacctccatgtcatctcatcgtgtttttccagatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcaaggtgaccgtgaatgtgctctgtgagtgagccggcgggcagagctgggtgggggcaggggccatggacctaatgcaatcctcaccgcctgttgtatcctccccacagccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggccccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctaatcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgattttttttttttttccagagacggggtctcgcaacattgcccagacttcctttgtgttagttaataaagctttctcaactgcc

SEQ ID NO: 36 - DNA, 27864 bp, Homo sapiens
atgctgacaatcttcttccttcccctggccacctctctgcccacttgcttcctcagtaccttggtccagctcttcctgcaacggcccaggagctcagagctccacatctgaccttctagtcatgaccaggaccagggcagcactcctcctgttcacaggtgagcctggaccccaatgaagtagggctggggacccaggcccaagggagccagggccctgaactgggggctcaggctggggggttaggatctgggtaggaagagagactcagtcaagcctgagggggaggcaggcacatagggtctgagatttggagtttgtggagggagaggatattgatgaaccaattttgggagagttccagagatgctggaagagaggccagttgtctctgtactgcagagatttttaaaataggcagaatgcgccaacttgtgctctgtggacaggatgctttggtccgcaagttttcctggactcactctcatagcgcccgaggtgcacgttggggaaagatcctttttagagcctgggtactgctctgcagaaatggagaactgcaactcgatagtggatggtgggcaaggggcatccctggaccctgggaaggagagaaggggatgagttgggtgtccagaagacccaggcaccccgggcatcaggctcggaggggagattgggacgctggggccgggggtggagggcagccaggcagaaggaagacccttctccaaagctctcttcccacctctttcccagccttagcaacttctctaggtttcaacttggacacagaggagctgacagccttccgtgtggacagcgctgggtttggagacagcgtggtccagtatgccaactcctggtgaggcccaggtggtgctggcctttggctccatccatcctctccctgctcagggccccatgcccccggccctgccctgttatttgcaaactctcctctctgtctggtgtagcgactgccctggctaatgaagatttgccttgaaggcaggcacggtctcacagctaacatttacagagcagtaagtgcagtgccaggctcatcacaggtggatgctgatttagtccacacgacagcctgtgagtaggaatcagtcgtgcaacaaacacttatttgttttttctttctttttttctatacatttaaaaatatatagagacagggtctcactatgttgcctgggttggtctcaaactcctgggctcaagcaatcctcccgcctcagcctcccaaagtgctgggattccaggtgtgagccaccacacccagactcaacaaatatttcttgtctccatacgccagagaatccaacagacagaaatcccttccacatggactttaaattattaaaatccatcttgcagatgaggaagctgaggctcagggagggaacgcaaacttgccggagtggcagctgtgctgcagcgtccacactcttacctaaagtgttctttgtctcctcgcagggtggtggttggagccccccaaaagataacagctgccaaccaaacgggtggcctctaccagtgtggctacagcactggtgcctgtgagcccatcggcctgcagggtgagtcaccgcccctcccgggacccagggccgggctcccaggcttccctgctccaggggcccgtggactcaccggagtgtcactttcagcttccactgtgtctgagaccctcaccctcagatatgcttcctggccccttaaggcctccccgcccatcgcactcccgcagctctgtcaagacccgacagcttccttcaccgtcagacctccttgtctcccaggtggaggtgacccctgcccagctcttccacagccttctctgtacccccgagagtgaccatgcacatatctgtccccacagtgcccccggaggccgtgaacatgtccctgggcctgtccctggcgtctaccaccagcccttcccagctgctggtgagtggccctgggtcacaggaggcttctgagggagggagggaggagccggggccgcggggggctgggagtctcctgtagggtggaggttccggaatgtgagggtgggaggaagcaggggcagccccccagcagcccgctgtgtccccaggcctgcggccccaccgtgcaccacgagtgcgggaggaacatgtacctcaccggactctgcttcctcctgggccccacccagctcacccagaggctcccggtgtccaggcagggtgagtgtcgggaccaccaaggctttgaggagctcacgcacatccaattgggggtgcggtgggctagagacagtcttgccagagtggatcagaaagaagggatctggaaaaagagttaccacgtgttgcagtggttcctgacgctgctgcccgcacatcctgccgatcgcccgcacgctgccggacctttcctgtgaccttaacctctccaagcctcagtttcttcatctgttggatggggataataacacacccagcactgaaagcaacacaggatgattcatggccaggggttagcacagcagctagcaccaggcgacagccccatgaaggccagctgttgttatttttagaggagaggatctattttcatccaatgggtcctgggatatgaccaattggtttgtgccgtagtttaggaaaggtcagtgaaagtgcagtgtgagcaacgtgtgtgtgtgtacatgtgtgtatatgtatgcatgtgtatacatgtgcacatgcacacatgtacatgcatgtgtgtgcatgtatgtgtgtgtgcgtgtgcacatgcaggttgagacgcagggcctgacttccctggtgctgatggggaagaaagataaggaagcaaaacagtgggctttggcaggctgaggcctccccctggtttcacatttgctctcaagcctttggtgagactgacatctggctgcaaatagggtgtgccttccagcacctccgtgggtccagactccatccacaggggcctgggcacccatcagaatgcccaggacacctgtctctccggtggaggcctctggggcagaggggatgcttgagaggtcacatggaagggggtttcctctccaggtgctggaagatcgtctcttctcaggacagatgctaacttcacacaggaggggagtgggggcctgtatttaagctgagaacagaacaggcccagtgtgtggctgttgcctgggatgatttgtttaaaatattaacaatcaaggcaagagggttgtttgaggcctggagtttgagaccagcctgggcaacatagtgagacctcatctctacaaaaaataaatataaaatacaaagtagcttggcatgctgttacatacctctagtcctaactactggggaggctgaggcaggagaatcgcttgagcccaggagttggaggctgtagggagctttgatcacaccactgcactccagcctgggtgacagagtgagactccatctcaattaaaaaaagaaatttaacaaaactaccattcagcactgagcagtgaggacaaacactggctagggactggtgccagtttgtgtcattgctggatggggtgacattgagggaggaaggaggggtgggtccagggaggggcacagatatccagggtggtggaggggtaggccctctgcttcctaccgtctgaattggagaaatcttcctggtttttttttttttctttttttttagagatagtcttactctgtcactgaggctggagtgcagtggtacaatcacagctcactgcagcctccaactcctgggctcaagtgatcctcccacctcagcctccagagtagctgggaccacagagaagagctaccatgcccagctgatttttaacaatttttagtagatgtgaggtctaactatgctgtccaggctgatcttgaaatcctgggctcaagcaattctcctgcctaggcctcccaaagtgcttggattataggagtaagtcactgcacccagtctgaccttcactcttttgttgatggggctgagcagcttcatcacagcctttttcattttttatttttttgagatggagcctcactctgttgccaggttggagtgctgtggtgcgatctcagctcactgcaacctccacctcccaggttcaagcaattctgcctctgcctcccaagtagttgggaccacaggcgcgtgccaccacacccacctaatttttgtatttttagtagagacggggtttcaccatgtgggccaggatggtctcgatctcctgacctcgtgatccgcccccctcggcctcccaaagtactgggattacaggcgtgagccaccacgcctggctcatcacagcctctttaggcaactttaagagaatgaagggccttgttccaggcaaggggttagggaagctctgcccctgatgaggagaggacccagggtgtggagcctgactcccatcgccagactaggggcttaggggaggaagggttttgggagagtgagctcttgtggccaggaggccacggtcctggactccaggagtgtcacttggaggaccggtgccacctccttccccagagtgcccaagacaggagcaggacattgtgttcctgatcgatggctcaggcagcatctcctcccgcaactttgccacgatgatgaacttcgtgagagctgtgataagccagttccagagacccagcacccaggtgtgcctttgggggagggaggctgctgggggtgggtgcttcgatcctggtgaaatggcctcagccccagccctgtgtgcttctcccagttttccctgatgcagttctccaacaaattccaaacacacttcactttcgaggaattcaggcgcagctcaaaccccctcagcctgttggcttctgttcaccagctgcaagggtttacatacacggccaccgccatccaaaatgtcgtgtgagtcctgatttcttccaggcacagtcccaaagcacccaggtcttcccttgggcctcatctgtctccacgagaaggggacaggcagggaccaaaatccagcccgtgatacccttgccaagctggggcctctgggtgggactggggcctcccaaaggaaaaggcatcttctaattttcacaagggcaccaggggctagtgtggtttggttcacaggcctctaagacctctcctttcctgataggcaccgattgttccatgcctcatatggggcccgtagggatgccgccaaaattctcattgtcatcactgatgggaagaaagaaggcgacagcctggattataaggatgtcatccccatggctgatgcagcaggcatcatccgctatgcaattggggtagggcgtgggatggcttcccacttctcccacggcttcctctcagggcaactcccctttctgtgtatgttcttttctctttgagacagggtcttgctctatcacccaggaagtggtgcaatcctagctcactgcagccttgaactcctgggctccagtgatcctcccaccccagcctccccagtagctgggaccacaggtgtgtgccatcaagcctggctattttctttttggttgagatggggtcttgctatgttgcccaggctggtctcaaattcctggccttaagcaattctgccaccttggtctcccaaagcacagggattacaggcgtgaaccaccgccaacaacatccctttcaaggatagaaacaccagctctctcggctcttactgccttaaggatgaaaactctgccccagactggagaccatgatcctttctcctaaactccctgatgctgtccgggcttcgtgtttctcctgtgtccaccgggtgtgatcatgttgatcttgtggggttattggaagatgttgcacccagtgcacacaggcacatttgatttattatttttactgagttgatcttttctggggacaggttggattagcttttcaaaacagaaattcttggaaagaattaaatgacattgcatcgaagccctcccaggaacacatatttaaagtggaggactttgatgctctgaaagatattcaaaaccaactgaaggagaagatctttgccattgagggtgagtctgaagggagctcttcgcttggggaatcctcagccgttaacacctttccacttagaacccgaggctccgtgaaacaggtagacagcgtctcggttctcctgctttcccgggaccccgatagccatgtctgtcagcttgtccccactgacgtcccccagcactgtcagagctgccccaaagtggccccagggatggccctgctccccacagagagtgatctcacaccaccaccggctccactgcagaacaaaaagcagtgccaggcccaacccaggagacccttccacccacaccgggccctacccagcccacatcccaccagccactcactcccctgggcaaggggcacacggacacctggccccctcgggtctgcttgtagacctgtggggggccctgatgaggaccagatcggtgctgccatcgctgtccacatccatggagcagaggggggccccgaagtcggagctgatctggagggcagagcctggtccctgtcacaggcaccagctctccctgtagcctccagtcttagcttctcctaaagctgaagtgttcttggacctggcaaagcccgtctccctccctggcactcaagcgtcatgccttcccccaggtacggagaccacaagcagtagctccttcgaattggagatggcacaggagggcttcagcgctgtgttcacacctgtgagtggggccccttaggccgatgatgtgccgtgaggggagggggagcagggaaggccagggtgggtgtcaggtgggtaagaggcgcaggcggaaggcatatctctggtacatgctgtcttcctgctccggcctctgctcagccctggaatccttttctcccaggatggccccgttctgggggctgtggggagcttcacctggtctggaggtgccttcctgtaccccccaaatatgagccctaccttcatcaacatgtctcaggagaatgtggacatgagggactcttacctgggtgagaaacagccaggggttggggacaggtgggagatgcactgcccagggtggggtccagggttctggggaaggggtatgggggctgtgctgcccagggtggggtccaggcttctggggagggaggatgggcactgtgctgcccggggtgggttccaggttctggggaggggggatgggggctgtgctgcctggggtgggggtccagggttctggggagaggggatgggcgctgtgctgcctggggtgggttccagggttctggggagagaggatgggggctgcattgcccagggtggggtccagggttctggggaggggagatggtgctgtgctgcccggggtgggggtccagggttctggggagggggaatgggggcctttgtgctgaggcctgggcccctcaggttactccaccgagctggccctctggaaaggggtgcagagcctggtcctgggggccccccgctaccagcacaccgggaaggctgtcatcttcacccaggtgtccaggcaatggaggatgaaggccgaagtcacggggactcaggttgggcgtgacaggagccagaggggaggatgagggtaggggaggtggctggggcagaggagaggatggaggggctttgagggccttgggggaggtcctggtacctggggagaggtgggacctggcccacagggctgcctctggcagggacaggcagcatgacccaggctctgcccttcagatcggctcctacttcggggcctccctctgctccgtggacgtagacagcgacggcagcaccgacctggtcctcatcggggccccccattactacgagcagacccgagggggccaggtgtctgtgtgtcccttgcccaggggggtgagtggctgatgggcctggggtgggtggggtctggtgtgggtggaggggttgcccgggttgggcctggcactgctttttttctgcagtggagaaggtggtggtgtgatgctgttctctacggggagcagggccacccctggggtcgctttggggcggctctgacagtgctgggggatgtgaatggggacaagctgacagacgtggtcatcggggccccaggagaggaggagaaccggggtgctgtctacctgtttcacggagtcttgggacccagcatcagcccctcccacagccaggtgaggccgtgtcccatttctgtcactagagcagcctgcttcttgcctctcccactctgtcatactggaaaactgtccctttttaccttttcctacctcccttgcccagctctgagcaccttgtagcagtggcgtggtctcagctcactgcaacctccgcctcccaggttcaagcgattctctgcctcagcctccagagtagctgggattacaggcatgcaccaccatgtccggttattttttgtattttagtagagacaggctttcgccatgttggctaggctggtcttgaactcctgacctcaggtgatctgcctgtctcggcctcccaaagtgctgggattataggcgtgagccaccatgcccaggcccctgccagttttacaaggtacacaggtcaggcacagaaaacccattttacagatggaatctgggacactaggaagacaagggccttggtttgttggaggttcagagtgggtccgagatggtgaagggcactccggcctcctgacctctaacccggtgtgcagtctcccggctccctgctgctcaccacttaggtccagtcatttcaaccttcccttccactcgcccctctcctccctggatgctacatgattttattcccttcctgccatcaaggtcccaccaaatgcccatccctgcagccgccctccaccccaagggagcagggttccctgagaacgaagggctgcttttcttggcaaaagtcaagaaagctctgttaaaaaataggcaaaggggctgctccaggtggctcacatctgtaattccgacactttgggaggctgaggcaggaggatcacttgaggccaggagtttcaggccagtctgggcaacatagggagaccccatctctagaaaaaattttaaaaattaggcaggcattgtggtgctgtagtaactgtagtcccaattactcgggaggctgaggtgggaggtcacctgagcccaggaggttgaggctgcagtgagctatgattgcgtcacttcacttcagcccaggtgaaagagcacaatcccgtgtcaaaaaaaaaaaaaaaaaaaaaaaaagggcaaaggatttggatagggtagacgtttctccaaagaagaggtacaaagggccaatgggtgcataaaatgattctcaatgtcattagtcatcagcaaatcaaaactataatgagatgccacttctcacctactagaatggctagaaacaaaggcggataatgacaggtgttggtgaggatgtggagaaccgggcatcctcccccatgctggggatgatgtaaatccacgcagctgctttggaaatcagcatggcaggtcctcaaaacattaaacataggctgggcacagtggctcatgcctgtaaccccagcactttgggaggccgaggcaggtggataacctgaggagtttgagactagcctggccaacacagtgaaaccccatctctactaaaaatacaaaaaaaaaaaaaaaattagctgggcatggtggtgggtgcctgtaatcccagctacttgggaggctgaggcaggagaatctattgaacctgggaggtgggggttgtggtgagccgagatcgcggcactgcactccagcctaggcaacaagagcaaaactccgtctcgaacaaacaaacaaacaaaaagttaaacatagagttgccatgtgatctggcaattccacctataaaacatgctaagtgagggaagccaaacacagaaggccacatgtattcaggccaaatgtccagaacagacagatctgtagagacagaaagtagatgagcagtttcacagggctgggtgtgggggaaagtcaggggcatgagggtgactgctaatgggtgtggagtctctttttggggtagtggaaatgttctaaaattgattgtggtagtggtttcacaactctctaaacataccaaaaggcactaagtcatatactttaaaggggtgagttgtgtgctatgtggtctatagctcaaaaaagctgttaccaaaaagaaaaaagtgccaaggaaggtccctgcagttctgtcacacaccagctgtgtgatctttgacaggtaactcaccctctctgtgctcagttttctcactggtaaaatggtgatactaatagaaccaaccttattgagctgctgctgtgaggattaaatgagttagtatgcatgaagtgcctggcacacaataggtatcatgttgttataatctgttttaattatcattaagatagtttaacaactggccaggcgcggtggctcccgcctgtaatcccagcactttgggaggctgaggcaggcagatcacttgaggtcaggagttccagactaggctggccaacatggggaaaccccgtctctacccaaaatacaaaaattagttgtgcgtaatggcgcatgcctataatcccagctacttgggaggctgaggcaggaaaatggcttgaacccaggaatcggaggttgcagtgagctgagattgcgccactgcactccagcctgggtgatagagtgagactccatctctaaacaaacaaacaaacaaaaaacacatagtttaacacctgaaggggaatctaaagaagagggtgaaagactgttgagaataacaagggcccacgtgttgtcatgaaactgcaaacagttcgtaccaattcccacaacccatcacatgcaggcataccttgttttatgcgctttgcagatactgcattttttacacgctgaaggtatgcagcgaccctgcactgagcaagtctatcagtgctgttttcccagctgcatgcactcactttgtgtctccgtgttactttggtaattctcacaatgtttcaaacttttttgtaattatcatgtctgtgatggtgatctgtgatcagtgatcttcgatgttgctattgtcctctttttggggcaccatgaagcacgtccgtatatgaaggcgaacttcataaatgtgtgtgttctgactgctccaccactgatagctcccctgtctctctctccctctcctgtggcctccctattccctgcaatgcaatgatattgaaattaagccaaataataactctacaatggtctttaagtgttcaactgaaaggaagagtcacatgtctctcactatttatttatttattgaggcaggatctcactctgtcacccagcctggagtacactggtgtgatcttggctcactgaaacttccccctctggggttcaagtgattctcctgcctcagccttctgagtagctggcattacaggtgggtgccaccatgcctggctaatttttgtgtttttagtagagatggggtttcaccatgttggccaggctagtctggaattcctgactctaagtgatctgcctgccttggcctcccaaagcactgggattacagacgtgggccaccacgtctggccacatatctctcactttagatcaaaacctagaaatgattaagcttggtgaagaagccatgccaaaagccaagatgggctgaaggccttttgcaccaaacagccaaattctgaatgcaaagaaaaagttattgaaggaaattaagagtgttactccagtgaacatatgaatgataagaaagtgaaacagcctaattgctgatatgaaggaagtctgagtgatctggatagaagatcaaaccagccacaacatccccttaagccaaagccaaatccagagcaaggtccgaatgctcttcagttctatgaaggctgagagacgtgaggaagcttcagaagaaaaattggaagtcagcagaggtggaagtcagcagggttcatgaggtttaaggaaagaagcaatctccacaacataaaagtacaaggtgaagcagcaagtacagatggagaaggcgcagcaagttctccagaagatctctgatgaaggtggctacactcaacaacaggttttcagtgtagatgagatggccttcgatggaagaagatggcatctaggactttcagagaagtcaatgcctggcttcaaagcttcaaaggacaagttgactctcttgttagaggctaatgcagctggtaggacttcaagttgtagccagtggtcatttaccatttggaaaattccagggccctgaagaatgatgctaaatccacccttcttgtgctctagaaatggaacaaagctggggtgacagcacatctgtttatagcatgcttgactgagtgttttaagcccattctggagacctgctgctcagaaaaatagatttctttccaaagtttgctgcttattgacagtgcacctgatcacccaagagctctgatggagatgttcaaggagattagtgttgtttccatgcctgcaaacacaacacccattctgcagtccatggaccaaggagtaatttcgactttcaagtctcattatttcagaaatacatttcataaggctatagctgccatagatagtgattcttctgatggatctgggcaaagtcaattgaaaaccttctggaaaaaaattcaccattttagatgccattaagaacattcatgattcatcagagggggtcaaaatatcaacattaacacgagttcgggagaagctgattctgattctcatggatgactttgagtggctcaaggcttcaggggaggaagtgattgcggatgtgtggaaatagagaaccagaattagaagtggagcctgaattgctgcagtctcatgatgaaacttgcacagatgaggacctgcttcttacagatgaggaaagaaagtgttttttttttttttcagatggaatctattcctggtgaagatgatataaatattgttgaaatgacaacacaagattaagaatattacataatcccagcacttagggaggctgaggtgggcagaccacctgaggtcaggagttcaagaccagcctggcctacatagggaaacctctctactaaacatctctactaaaaaaattagctgggtgtggtggcagatgtctgtaatcccagctactcaggaggctgaggcaggagaatcgcttgaacccctcaggcaaaggttgcagtgagccgagatcacaccactgcactctagcctgggcgacagagtgaaagtgtgtctcaaaaaaaaaaaaaaaaagaatattatataaacgtagttgataaatcagcatagaatttgagagaattgactccaactttctttttttattttttattttttatttatttttttattttttattttttttattgatcattcttgggtgtttctcgcagagggggatttcgcagggtcataggacaatagtggagggaaggtcagcagataaacaagtgaacaaaggtctctggttttcccaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaagaggatcccaaggcagaagaatttttcttagtacagaacaaaatgaaaaatctcccatgtctacttctttctacacagacacggcaaccatccgatttctcaatcttttccccacctttcccccctttcgattccacaaaaccgccattgtcatcatggcccgttctcaatgagctgttgggtacacctcccagacggggtggtggccgggcagaggggctcctcacttcccagtaggggcggccgggcagaggtgcccctcacctcccggacggggcggctggccgggcggggggctgacccccccacctccctcctggacgaggcagctggccgggcggggggctgacccccccccccacctccctcccggacggggcagctggccgggcagagggtctcctcacttcccagtaggggcggccgggcagaggcgcccctcacctcccggacgactccaactttcaaagaagctctactgtggccaaatgttatcaaccagcatcgcatgctccagagaaatttcatgaaaggaagagtccatccaggcagcaaacttcctcacggtcttattttaggaaattgccatagccaccccaacctccagcagttgccactgtgatcagtcagccgtgtcaccatcaggcaagaccctccaccagcaaaaagattatgccttgctaaaggcttaaacgattgttagcattttttaccaatcaaatattttatttttatttttgaacttttagatttagagggggtacacctagcctttctagactccctcagtaattggtaaatttctctttttattttgttattattcctttttttcttttcttttttttaatttttattttttagagacagaatctcatcatgtcactcaggctggagttcagtggcgcaatcatagctgactgcagcctcgaactcctggactgaagagatcctcctgccaaagactcctgagtagctgggaccacaggcacaaagccagtgtgccctgcccattattattacctttttttttgagacagagtctcgctctgtcacccagactggagcacagtggtgcaatctccgctcactgcaacctctgcctcccgggttcaagtgattctcctgcctcagcctcctgagcagcttggattgcaggtatgtgccatcatgcccagctaatttttgtttatttagtagaaacggggtttcaccatgttggccaggctggtctggaactcctgacctcagatgacccacccgcctcggcctcccaaagtgttgggattacaggtgtgagccaccgcgtccagccattattatcacttttaatggctgctagttccagggtgcacagagatttaaagggcacattcttccagggattgggcataacatgagcactgggaatgaaggtgataggttctacaggggaggcagtgcctgggagggtggatctgggtgtgggtgcgaccactccctaccccaccgcggctttttcttgtcctttgaagagacagagtgacagcaagaaacaaaaaggggacttgggcctggggttggacggtctggtgttaggtctgcagtcagcctcttaaaggctacctggggttgacactgtccccaacctctctcctgcatctttgcaacgagggaggtgaggttggacaaactctgaggtccctttcagccttaatactcattgtgatatattattgactgctggctgtatcctgggtgctgttctaagaaccgtaggaattcctctcctgagcatggctaaactctgagctaatagtatcattatatgaaagatgaggaaacggaggcacagacagattgagtccttgcccacggcctcgtggctcatacgtggaggagtcagaattggaactagagactgatcgaatgaatgacactcgggtcaccaggacacccttcctatctccactcttacatctgtttcttagcaatcatctcccaactcctacctcctcttttcaggttcttcttggtgacatctgttcacaactcaccccttctctccctttccgatggtcctacctccatattccccttgttacttatttccaacttcttcccctactttccatcttgattcacccttctctcctctggccagcggatcgcgggctcccagctctcctccaggctgcagtattttgggcaggcactgagcgggggtcaagacctcacccaggatggactggtggacctggctgtgggggcccggggccaggtgctcctgctcaggtgagagcagcctttctcagaggctccccaggtggtcctaggttcagatgggggtgcccaccccacgtggtgctcccaggagccgacggcctgtcctcagctcggtgctctgcccgcaggaccagacctgtgctctgggtgggggtgagcatgcagttcatacctgccgagatccccaggtctgcgtttgagtgtcgggagcaggtggtctctgagcagaccctggtacagtccaacatctgcctttacattgacaaacgttctaagaacctgcttgggagccgtgagtcccctcccctccaacccaggacaccctgacctctggagtcccccatcccaggcccctgtctcccaccctgctcattgtccacccaaggagttcctgtctcaacgccgtccctgcgaccgcctacaggtgacctccaaagctctgtgaccttggacctggccctcgaccctggccgcctgagtccccgtgccaccttccaggaaacaaagaaccggagtctgagccgagtccgagtcctcgggctgaaggcacactgtgaaaacttcaacctgctgctcccggtgcgtctgggcatgaacgtgggtggcggccgcgctggggctggcagaaggcagggcagggagagaacaggctgtgttccggcctccctgtggctcagcccagcacaggaccagccatgcaggacgtgcttactgcacgttagccagtgagtgagtgagcgagcaaacaagtgatgagatcggctgcaatttccaggggccacacgattggatttcaggaaagagaattgggcaacctgagagagctctggggcttccggctgggctttttttcaggcattcactggacaggggtttatcgagctgctcctgggagacaggccttgccctgggggccaggggcataggtggccaaaacagtcattgctgatcgggaggtctggggggggggaggaaaaaaacaaagacaaacaaggggagagaacagagagggtgtcagggaggcctcctgaaggcggtgacgctgagcaggctctggaggaagctgaagccgcgcgggagctgggcagaggcaggataagaactgcggatgaggccgagcgcagctcttaccctccccttaccctccgctccccgcgacgcccgtcccccagagctgcgtggaggactctgtgacccccattaccttgcgtctgaacttcacgctggtgggcaagcccctccttgccttcagaaacctgcggcctatgctggccgccgatgctcagagatacttcacggcctccgtgagtcctggcactgggtctcccagagagggtgcacagcgtggggcctgggtctcggagaaaaccccccgttgccttcccacgcagctaccctttgagaagaactgtggagccgaccatatctgccaggacaatctcggcatctccttcagcttcccagggtgagcgcccccaccttagacctgccctactgccccagcctccttcctggaatctgggactcctgcctctggctctccctaacattgtctcatcctatagtcaaaacccaggtgtcttggctgggcacagtggctcacgcctgtaatcccagcactttgggaggccgaggtgggaggatcttttgaggccaggagttagggatcagcctgggcaacagagcgagatcccatttccacaaaaacaaaacaacaacaacaacaacaacaacaacatcacttgagtgtggtagagcatgcctatagtcccagctacttgggaggctgaagcttaaggattgcttgagctctggagttggaggctgcagtgagccataatcacaccactgcactccagcctgggtgaaagagcaggactctgtctcttaaaaaaaaagaagaagaagaagaagaagaagaagaagaacccaggggtccgtcccctgtctatctcccaaatccccacccaccccattttatcccagaccatttctagcctcagtcacagaatcatcttctcctttccttcacctgatacccagcttgaagtccctgctggtggggagtaacctggagctgaacgcagaagtgatggtgtggaatgacggggaagactcctacggaaccaccatcaccttctcccaccccgcaggactgtcctaccgctacgtggcagagggccaggtgcaccctctggggaaggaggaggaggcagggctgggcgttagcgtagattcccgtgcggttcagaacccgggctgggcttggaggtggtagtgccatctggggcacgcctctgctcgtgtgggtgttcaactttgggcatcgcagtttaaggacactgactatcaggaatgatttcctgagaggccactaatgtggagacagaggggaacctgcccaaatttctttctattccatattatatcagtattcctcttttaaatgaaaacatacctcagccttcaaatattttaaaacactgttctgtagaagcaaggggttgaatttattggtcactctacattaaggcttggcgacctttttctataaagggctagatagtaaatatttcagcttcgtggtctgcgtggtctgtgtcacagctgctaacctctggtgttgtggaatgaaagcagccattgacatgaatgagtttatgagtgaatatacctgcgatgcagtaaaactttataaaaataggtagtggctgttggttgccaatccctgctttaaaatgcagaactaggaccacggggagtcaaagagaaccagattttttaaacaaagatgttattatggctgggagtggtggctcacgcctgtaatcccaggacttcgggaggttgaggcaggcggatcaccggaggtcaggagtttgagaccagcctggccaacatggtgaaaccccatctctacgaaaaatacaaaaattagctgggtgtggtggcaggtgcctgtgatcccagctactggggaggccgaggtgagagaactgcttgaacccggaagacggaggttgcagtgagctgagattgtgccactgcactccagcctgcacaacagagcaagactctgtctaaaaaaaaaaagttattatgaaaaatttaaaacatttacaaaagtagaaagtagttcaacaaacctccccaaaacttgtcacctagattcaacaattagcagcattttgccacatttgtttcatcaatttttcccctttgctaaggtattttctttatttctttatttttgagacagggttttgctctgtcacacaggctggagtgcagtggcacaatttcagcttactgtagccttgacctcctgggctcaagcgatcctcccatctcagcctcctgagtagctagaaccacatgcacacaccaccacacctggctaattttttaattttttttgtagagttggggtcttaccatgctgcccaaactggtctctaacccctgggttcaagcagtcctcctatcttagcttcccaaagtgttggagttacagacatgagccactgtgcctgacctgctaaagtattttaaaacaaatctcagacatgggggtcattgtactcctccttattcactctgctatggtttgaatgcatcacccaatgttcgtgtgttggacacttaatccccaatgcaacagtgttgaaaggtgaaaccttttaaaggtgattaggttatgagggctttgccctcatgaatggatgaatactattatctcaagagtagattagttatttcaggagtgggtttccttccttcctttcttctttctttttctttctttcttttccttctttctttctttccttgagagggtcttgctctgttgcccaggctagggtgcagtggcacgatcttggctcactgcagcctctgcctcccgaattcaagcaattcttgtgcctcagcctcctgagtagctgggattacaggtgcccactgccacgcccagctaagttttgcatttttagtagagatggggtttcaccatgttgggcagtctggtcttgaactcctgacctcaaatgatccacccgattcggcctcccaaagtactaggattacaggcgtaagccacggagcctagcccaggagtgggtttctaattaaaggatgagtttggccccctttccctctcactctcacatgcactgccttgcacatgcagcacaaaggccctcaccagatgctggtgccatgttcttggacttcccagcctccagaaccacaaagcttctattgatacattacctagtttgcggtaatctgttatagcagcagggaacagacaaagacacactctatagttctgaacaatgaggacctcttatatgacctcaacaccattatcacacccaatgaaataagtgattccttggtattaagatcatagtcaaaattgtgtaactgtctcaaaaatatctttttacttctggtctatttgaacgaaaattcgaactaggtccatacatgatggttggttgttatttctgctgtctctcttagtctaatattcccagcggaagcgcattttgattaacgtataaaagaacacagcaggaaaggccatctcttgcatgtgaggggtgatcactgtcaatgaaagtgctcctagacatatcaaccaaatgtaatgggtggacctttgctgaatattgattttaacaaatgagctgtaaaataacatttttggagacaatctaagaaaatagaacatgaccagtatattggtatattaaggagtaattgttaattttgttggctgtgatttgttggttcttgtggttacatttaaaatacccttatctattggtggtatacactgaagtatttctagatgaaacaatatggtgtttggaatgtgctttaaagtgttcagaaagagaacatagcagaaacaagagtagaaaaatgttggttacttaaaatgagtgatggttatatggggttgattttccagtctctctattttttaatgtgttttaaattttccattataagaggcctttaaaataacaataaaaaggtgaacattttaatacatttgagatttctactttggaagaaagtttgaccagatagctatgggggagcttttaaaaacgtaaccttggctggacatggtggctcatacctgtaatcctagtgttttggggggacaagatgggaggattgcttgaggccaggagttcaagaccagcctgggcaatatagcgaggtcccatttataaaaaaatttttttaaaattagccaggcatggtggtggtgtgtgcctgtagtcctagctactcaggaggctgaggcaagaggatggcttgaggccagagtttgaggctgcagtgagctgtgattgcatcactgctttctagcctgggtgacagagtgagacctggtctcaaaaaacaaacaaacaaacaaaaacataagcttaaggtgggctccaggaagctttatcactacttcgtggcgtgtctttggaatgctgttatattaggttggtgcaaaagtaattgggtttttgccattgctttcaatttcaactaatactcctctactttttctcatgcctagaaacaagggcagctgcgttccctgcacctgacatgtgacagcgccccagttgggagccagggcacctggagcaccagctgcagaatcaaccacctcatcttccgtggcggcgcccaggtcagcctggcttctgtcccctcactgctcccctgccccaccctgtctttactgctctgtgacctctcagttccttttcctcagatcaccttcttggctacctttgacgtctcccccaaggctgtcctgggagaccggctgcttctgacagccaatgtgagcaggtgagccgggccaggccaggggcagtgcccctcatctccagcctcacaccccattctcctcctctggggcctctggcaactgagtctctcctctttctccagtgagaacaacactcccaggaccagcaagaccaccttccagctggagctcccggtgaagtatgctgtctacactgtggttagcaggtcagcaggtaccccactgcaggaaaaagggttcttctctctgacctcaaaaagaaaaaaaaaaaaaggccttgaaacgctgccacagagggtgagataaggtgtttgaaactaaaaggtcaggtgtttcagcagacaccttccttcagccaatgccttcctcgaatttgctgtgtgccaggcagggtgctgtggttattttccatacattcatttgacattcattgaagatttactgagcccccattatgtgtgatcaaaaccagacatgaaccctcgcccttgtggggtgtgccttgctggatgttctcctgtgcctggtgtttcccactctcacctgcacctgcatgcgtggaggctcccagccaggtgcacgctctgagctcgtgtgctggggtgtgccccaggctctcataccccttggcaggggacccacaggcagggctcacctactctaggcatgtgtggtccacagcttggccacacatggcaggtgtgatccacagcttggccacacatggcaggtgtgactctgtgggttagggcacagggagtgccaggttggggcatttctgggggaggccaaggtgggaggattgcttgaggccaggagttcaggatcagcctgggcaatatagtgagaccctagctctacaaaaaattggcagaggaggaatgaggcttcagagtaggcgtggtgggctggtgtttggactatgccagctggaggacaggtgccggaagagtgaagcagtgaggcagtggtgagactggccacctgtgtgatggtcccagctgcccaccaggtctccaggcttgtgcccaaaaagggctcaggaggtgttaaactgagacctcatgaagagtctgctgtgggccctccctcccctccaagccccaggcccggaaaagccaaggaaatgggaaaaaagggcccccggggaggtatgtgggggactgggaaggggcaatgctcagtagcatttggtcaacagcgtcagcctgggccaccccaactctgtgctgtgtcccacagagccctggcatcctacatccccacaaagggatggaaggaaagcggaggggcaggccatggcccctgctctcctgcagtcagtggcagagctctctgctccgttcattgtaccgactacccggccccactggcagcctcctctgcaggcagctatgagctctttgcctcatttttttttttttaaagcccaggtcttgctctgttgcccaggctggagtgcagtggtgtgatcacagctcacagcagccttgaactcctcttgggctcaagcgagcctcccacctcagcctcccaagtagttgagactacagatgtgtgccaccatgcctggctaatttaaaaaattgttttggagagatggggtcttgctatgttgcccaggctgatcttgaatcctggcctcaagtgatcctcccacctcaacctcccaaagtgctgggattgcaggtgtgagccactgcactcagccaattagcacttgtttgaagcccagccctgcttttctagactctctctctttttttttttttttgagaccaagtctcactgtgttgcccaggctggagtgcagttgtaccatctctgctcactgcaacctccgcctcctggctccaagcaattctcgtgcctcagcctcccaagtagctgggattacaggcacctgccaccacacctggctaatttttgtatttttagtagagatggtgtttctccatgttggccaggctggtcttgaactcccgacctcaggtgatctgcctgtctcagcctgtcaaagtgctgggattataggcgtgagcactgtgcctggtctctaaactctctctctctgtttttttttgagagagagagagtcttgctctgtcattcagtggcgtgatctgggctcactgcaacctctgtcccctgggctcaaacaattctcctgtctcagcctcctgagtagctgggattacaggtgcacaccatcatgcctggctaatttttgtatttttagtagagacagggtttcaccatgttggccagggtgatctcgaactcctgatctcaggtgatccgcccatctcagcatctcaaagtgctgggattacaggcctgagccaccgcgcctggcctctaaactctcttataacctaactcagccacagccctcattccaggacattccaaggccccaccgaccacctgtcctctcatgctctagccaatgccttctgcagatgccccatggtagttcacatccacttatgcgtcttctctctccagccacgaacaattcaccaaatacctcaacttctcagagtctgaggagaaggaaagccatgtggccatgcacagataccaggcaggtggtggagacgcaggagactgggctggggtgggaggctgggagccggagactggggagggatttgggctttggcgtgggctctgccctcagtgccctctgtgcaggtcaataacctgggacagagggacctgcctgtcagcatcaacttctgggtgcctgtggagctgaaccaggaggctgtgtggatggatgtggaggtctcccacccccaggtacccaaggactgcatgtggctcctccacgaatgccctttctacctggattccttgtgccccatgtgggtccctgatgtcccagctgagacacttgttctctgcattttcccccagaacccatcccttcggtgctcctcagagaaaatcgcacccccagcatctgacttcctggcgcacattcagaagaatcccgtgctggtgaggagggctctgggctggccctcactgtaggccccacatcagaggaatttaacccaggagttcatgttccatatccatcctgctgaagtaccctcttgcattcggatatggccgctgccctcaagtcacaccgcataatgctgcctcccaccttcacactcatctttctcagccccatgctatttatctgcccccaggactgctccattgctggctgcctgcggttccgctgtgacgtcccctccttcagcgtccaggaggagctggatttcaccctgaagggcaacctcagctttggctgggtccgccaggtgtgtgggtgcaacgacagagcccctgccccagactcaggcgggacctggcatgtctgtgcccatctgcaagccagggcacccccagagctctgagcctcccccagagccagttcaacaggtttcccccaacccctttgcagatattgcagaagaaggtgtcggtcgtgagtgtggctgaaattacgttcgacacatccgtgtactcccagcttccaggacaggaggcatttatgagagctcaggtagagaccatgtggagggcagcgaccaggctggaaagagggcccctagggctacatctgtggtgctgggtggggggtttgcaagccttgggggaggagggcgaaggcctctgggcaggatagctgtccctaagggcacgggtgctgctgtgtctcacctcttggagcagggcctggggaaggaggggagggagttaaaggttggggagcctgggaggagtctgggatagtaggaggatgggagtgctctgacagggtcacttccacttcagacgacaacggtgctggagaagtacaaggtccacaaccccacccccctcatcgtaggcagctccattgggggtctgttgctgctggcactcatcacagcggtactgtacaaagtgagtgttttatgccactcttgacaccaccagcatctggtcccgctctttttgcagagtgagaaggagctcactttgaaggcagaggcacattcttactgggtcacttcatatgagaaactgcttcccacctgcaatgtcacctgtccccagtggccccctgctttgtgattcccaggcttcctctaatatttctccctttctttcctgctcttctccatcattctacgtgtttcccttgacagcagattatcatataaaagcacagacctgggtttgaatgtcgacatcaccacgggttctttttgtctttgaccataggccagtgtctgctccactctgggccttgatttctcaatgtgaaggtgattctaccccagctcatagaattttggctaaatctaggctgggcacggtggctcatggctgtaatcccagcagtttgggagatcgaggcaggtggatcacttgaagtcaggagttaagagaccagcctggcctacctggtgaaaccccgtctctactaaaaatacaaaaattagttgggcatggtggaggttgcagtgagccgagatcacgccactgcactccagcctgggcaacagagtgagactccatctcaaaaagaaaataattttggctaaatctagatgacatgatgcatataaagttcctagtgcagtgctttgaacctagcaaggatttcagaaatagtgacccctctccctcagtcatctcttttcctctcttccactgaatgggcttcctgagtttcttcttcgtcctcccccctaggttggcttcttcaagcgtcagtacaaggaaatgatggaggaggcaaatggacaaattgccccagaaaacgggacacagacccccagcccgcccagtgagaaatgatcccctctttgccttggacttcttctcccccgcgagttttccccacttacttaccctcacctgtcaggcctgacggggaggaaccactgcaccaccgagagaggctgggatgggcctgcttcctgtctttgggagaaaacgtcttgcttgggaaggggcctttgtcttgtcaaggttccaactggaaacccttaggacagggtccctgctgtgttccccaaaggacttgacttgcaatttctacctagaaatacatggacaatacccccaggcctcagtctcccttctcccatgaggcacgaatgatctttctttcctttctttttttttttttttcttttcttttttttttttttgagacggagtctcgctctgtcacccaggctggagtgcaatggcgtgatctcggctcactgcaacctccgcctcccgggttcaagtaattctgctgtctcagcctcctgagtagctgggactacaggcacacgccacctcgcccggcccgatctttctaaaatacagttctgaatatgctgctcatccccacctgtcttcaacagctccccattaccctcaggacaatgtctgaactctccagcttcgcgtgagaagtccccttccatcccagagggtgggcttcagggcgcacagcatgagaggctctgtgcccccatcaccctcgtttccagtgaattagtgtcatgtcagcatcagctcagggcttcatcgtggggctctcagttccgatttcccaggctgaattgggagtgagatgcctgcatgctgggttctgcacagctggcctcccgcgttgggcaacattgctggctggaagggaggagcgccctctagggagggacatggccccggtgcggctgcagctcacccagccccaggggcagaagagacccaaccacttctattttttgaggctatgaatatagtacctgaaaaaatgccaagacatgattatttttttaaaaagcgtactttaaatgtttgtgttaataaattaaaacatgcacaaaaagatgcatctaccgctcttgggaaatatgtcaaaggtctaaaaataaaaaagccttctgtg

SEQ ID NO: 37 - DNA, 18501 bp, Homo sapiens
gctttaatggcattaggacagtgggctgggcctgtttagaaactcatgtacctgactgtatttctcagcctcagtctctgtgggatgcagaggttcagtgctctcaacaacaagggccaagaaatccaagtgtccgggcccctgctccctccaagggtcaaggtaaagaaagcagcaagcactgtggtgagaagaatcagagggaggcaatgaaaggaagagaagaagtcatgagggatggagaccagaaacacagagagaggtaagggagtgggggaagttgagacagttggcaggacagcgcgtccacacccatgcacaccaccaagattaaccccataatcctctgatcttgtggaagctcatttgtagtcttctagcccaaagaaataaccgtttttctgaaatgttaagcatccttccaagggtatcagagtgatatggagaaatatggtaagacagttacagaatcagagataacgacactgattctaaaagcattattaccaaggcattgttgcattaagactgttttttcttttcttttagagacagtatcctgctacgttgcccaggcatgtctcagacccctgggtttagtgatcctcctgcctcagcctccccaaatgctgggattacaggcatgagccgggctgtttttaattctaagtaatttataatttacaattacacctaacaatggcttcaacaaggggtgtccaatcttttgccttccctgggccacactggaagaagaagaattgtcttgggccacacataaaatacactaacactaacgatacctgatgagctaaaaaaaaaaaaaaaaaaaaaaatcccccaaaaatctgataatgttttaagaaagtttatgaatttgtgttgggctgcattcaaagccatcttaggccatgggctggacaagcttagcttagaaccaagacgaaatttatggtttactttacaagaattttgcaagagggtaatactaggttaggttatatctggaaaatatcatcaagaactacattcattttaatcttttctcttttttatccctaatatggtgactttttttcctggggattgccacttcatggctccaagaaagctaccacagctcctgacttcacattacagcaggggtccccaacctccaggccatagaccaatacacagaccgataccggtctgtggcctgttaggaagtgggctgcacagcaggtgactggcaggtgagcaagagaagcttcatctgtatttatagccactccccattgctggcattactgcctgagctctgcctcctgtcagattagtggcggcattagattctcataacagtgtgaaccctactgtgaactgtgcatgccagggatctgggttgtgtgctccttatgagaatctaatgcctgatgatctgtcactgtctcccatcactcccagatgggactgtctagttgcgggaaagcaagctcagggctcccacggattctacatcattgtgagttgtataattatttcattgtgtattacaatgtaataataataatagaaataaagtctacaataaatgcaatgtgcttaaatcatcctgaaaccatctaccccgccaccccatggagaaattgttttttatgaaactggtccctggtgccaaaaatgttggggactgctacactccagcatcccacaccaggaggatggggatgagatggagaatcactgaagatctttaatcagaagggtgatatgttcatttgtactttataaacatttgtgtttgtattttataaacattttcttgggatcataacaacagatgcattttagaagattcccaaggtatgaagggtaacaaatgaagacgtgcctaggagtcacatggaagccaacactttgtaaggggattaaaataaagggaatggcagaggacatcattatgcacagaggagaagggcccaaatgtcaagagaaaacaagagacaagggactccacagagagtaattgccagaaaaatttgtaggtcttttgaagtctgactgttcttcctaaaacgggggtcctgggacacccctacctgtttcccatgagccctcttttctaaaacataagtaggttttcttcctggctaccaaatggcctgtgattagcacactaggttgggcaaaaatagagccaagtgtgtgttccaaagtgactatggtgaagaaaaaagcgaaagtcttaaaatggacttccacttctgtgtttgcgtaaggctaaaagggaagatgtcttagggttgaccggaatgggagtattcctgcctatgctgcaaaagtccctgactcttctggtaactgaaacatgagaaatggcctcggcgagcagcacagcctcccagtaaagcactggactgaggtggtaaagccagattgcctggactagaatcccaggactactgttcactagctccggacaagccagctaatccaggggtctcaaacatttcccccaactttttttttttgagacagagtctcactgtgtcacccaggctggagtacggtggtgtgatcttggctcactgcagttttgcctcctaggttcaagtgattcccctgcctcagcctctccagtagctgggattacaggtgcccgccaccacgcctggctaatttttgtattttttaagtagagatatggttttgccacgttgaccaggctggtcttgaactcctgacctcaaacaatcacttgccttggcctcccaaagtgctgggattacaggacggaaccactgcactgggccacaaacatttcctatgaagagccagatggtcaatatatttcatttggcaggccatagggtctccatcacaactccttggctctgctgttgtagcctgaaaacagccacaagcaaagttgtaaatgaggagcatgactgtatgtcaataaaactttatttaaaacacgacaattggacttcatataagttttgcatggcacaaaatacccttcatttgattttctttagccggtaagaaatattaaagccattcttggctctcaggccatacaaaaacaagcggtggctagatttgacccctgatttaactgcactgggtcccagacacttcacctgtgaattgagagcaatgatacttacagaggtgttttctggagcagaacaaataagatcagtgatacaaagcacttggcatgaattccagtgcaataagtattatcaatatcttagtaattacataaacctctctatctgctgtttcacgttctctgcggtgaacccatccatgcttaaaacttgaaccacacctcagctaacattcaccagacccctgtctctagctcagacctgcccttgatgttcagacacatcattttgggttcctgtttcctttcaaactcatctgcagcctttgctctcctcaccttctcccacaactctgttaaggactaaattgtgtcacattccccttcaaattcttaggttgaagccctcaccccatgatatggtttggctgtgtcccaaccctgatctcatcttgaattgtagctcccataattcccacgtgttgtgggaggaaccaggtgggagatagttgtttcatggggacgatttcccccataatgttctcatggtagtgaatatgtctcacgagatctgacgattttatgaggggtttcccctttcacttggttctcattctcttttgcctgctgccatgtaagatgtccctttgttcttccttcgccttccgcaatgattgcgaggcctccccagccacatggaactgtgagtccattaaacctcttccctttataaattacccagtcttgggtatgtcattattagcagcatgagaattgaccaatacaccccagcatgtcagaatgtgactgtatttggggatacaacctttaaagaggtaattagctgaaactgaggtcattagggtgggccccaactcaatatgactgatatccttatgaaaagaggagatccagacacagacaggcatagagggaaaactgtgtgaaaacatgaggaggaggcggtatctgcaagccaaggagagaggactcaggaggaatcaaccctgctgacaccttgatcttaaacttccagctgataaaactgtgagaaaatatatttctattgttgtagccacccagccaatggtattttgttatggcagctctaacaaactaaacactctgcttcttttcattgactctcgtctcaatgacagcccccaaatccacgcagttaccttggtgcaacagttctgaagaaaatggccacaatattcttggacactccttccactgacaggaaggcaggcatattgtatcgcctctcccctggaacctgggtagggttgggactactttgaccaaagaacgtggtagaaatgacttccacgtagctttcaaggctaggtcaaaaaaggctaggaagcatcttctggttctcctgggacacgtgttctggaggaaggcagccattgtcctgggactttgattcctctgagaccaccatgctggaaaggctgcctgtaggcacttggtgcaataccagcctagttcagcatttgagtcattccaacccaggcatctgacatgtgaatgaaggagctctagatgactccaattcacagtcttctagtcaccccccagacctttgagttttgggtggcagagacaagcatctctgtgccttatcctaattcccaacccacataatccatgaacgtaatgaaatggttgttttacatgctatgatttgggtggttatacagcaattatgaattatgaatgtgggcttcataaagacccttcatgcttcctcattctccagagccatttggtctccaagctcagtctaccaagcctggaaatctctccctaaactacacctcctctctagcacactactccagcacaggcaattattcgacaagttcaccttgatctctggcaacttcttaccctttaagatctctgcctccaactgggagcattctcagagccatccctttgcagggggactctagagcaatgttttctggaagcacacacctgacaagtcactctcctgcttaaatagcttttaagcagaagaaattgtaagaaagaaatttttttttagaccaatatccttgatgaacattgctgcaaaaatcctcaataaaatactgacaaaccaaatccagcagcacatcaaaaagcttatccaccacgaccaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgctaaaaactctcaataaattgggtattgatgggacgtatctcaaaataataagagctatctatgacaaacccacagccaatatcatactgaatgggcaaaaactagaagcattccctttgaaaactggcacaagacagggatgtcctctctcaccactcctattcaacatagtgttagaagttctggccagggcaattaggcaggagaaggaaataaagggtattcaattaggaaaagaggaagtcaaattgtccctgtctgcagatgacatgatggtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactctcattcacaattgcttcaaagagaataaaatacttaggaatccaacttacaagggacgtgaaggacctcttcaaggagaactacaaaccactgctcaatgaaataaaagaggacacaaacaaatggaagaacattccatgctcatgggtaggaagaatcaatatcgtgaaaatggccatactgcccaaggtaatttacagattcactgccatccccatcaagctaccaatgactttcttcacagaattggaaaaaactactttaaagttcatatggaaccaaaaaagagcccgcattgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggaaaaagttttcacaacctactcatctgacaaacggctaatatccagaatctacaatgaactcaaacaaatttacaagaaaaaaacaaaaaactctatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaaaaacaggtgctggaaaggggagaaataggaacacttttacactgttggtgggactgtaaactagttcaaccattgtggaagtcagtgtggtgattcctcagggatctagaactagaaataccatttgacccagccatcccattactgggtatatacccaaaggactataaatcatgctgctgtaaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaaggacaaaaaaccaaacaccgcatgttctcactcatagatgggaattgaacaatgaggaaacatggacacaggaaggggaacatcacactctggggactgttgtggggtggggggaggggggagggatagcattgggagatatacctaatgctaaatgacgagttaatgggtgcagcacaccagcatggcacatgtatacatatgtaactaacctgcacattgtgcacatgtaccctaaaacttaaagtataataataaaaatatatatatatataagaaagaaattttaagaagaaattctaagttctttttacagcattcaagaccaaccaagaaattgcctctgccgccctctacatacttaatgcttattgctgtctgccttatcatctatgctctggtaaacaaaagtaacctgcttttttgtgacccctttcgtgggtatttttactcccctctgacaagaatgcattattttttctcctttatctgagtctttaagactcagcctacatgttccctcctccggatattgactctagatccgtgaatctgagttagtggttccttttagaggacctcacaaggagccaggcatctgtctatcactacgtgcccccaccctattgtaactaagcactgcattctcacctctctattcaggtggtccgcagagcccatgtctgattgatctctatgtctccagcagccagcaaggaagcacctctttagagacctgcacctatacaatacctaccaccttttatttctcgatatgtgaactccattgagaacaaacgagtaaatgtaggtaatgtgccttcttcttttcttttcttttctttttttttttagatggagtctcgctctgttgcccaggctggagtttagtggcacaatctcggctcactgtaacctccgcctcccaggttcaagcgattctgccgcctcagcctaccaagtagttgggattacaggtgcccaccaccacgcccagctaattttttttgtatttttagtagaggtggggtttcatgatgttggctaggatggttttcaactcctgacctcaagtgatccacccacctcggcctcccaaagtgctaggattacaggtgtgagccacagcgcccagccagtaatgtgccttcttaagttctgtgagccattctaacaaattatcagaacagaggaaggggttataaacatccccccacccccgatttatagccagtcagtcagaagtacaggtggccacctgggacttggattggtgtctgaagtgaggacagttttgggagagtgagccctttaacttgtgggatctgacactaactccaggtagacagcgtcggagctgaattgaattgtgagatacccagtggtgtccccagagaactggagaattgcttgatatggaaaagacccacacatttgatgccagaagtactgcataagtcgagaattgagtttgacttaatcatcatatttgggcttgattgcgtggctgaaactcttcccacttcagtaattgtttctttcattttcatgaaactctgaagaaggaagggctggacattcagattccttgacccttgacatttggaagcatgaactccagtctctcacagaaggctagaggtgaaggaacattcagacacattggtttctaagaagagtccgctgacaacatacccaaggtgtcttctgaaaattataagaaatcctgagtttctgttaggggattggctccagctccattgtccctcccccatcattcagtagtctccgcgaaagcccttagagccggtgttgctccacaggaagccaagaagcacacaggaaaaggagcttagctgctggtaagttggggactgacaatttaaaatttatcaatggaactcctgctctctgacaaacacctcctaaattctagagcagtgctgtaatggagcatccacttgccacaggtggcttttgagtgcctatgtttctatcttgatctgaaatgtgcttaagtgtaaaatatacttagtgtagtttaatcattagtatgatcaaaataatacaatttatctcgttaataactttcattttggtaacgtgttccaatgattttttttatttgcggggttaaatgaaacatattattataattaatttctcccaatgattttacttttttaacatggctactagaaagttgtaagtcacgtgtgtggctggcatttagggcttgcattaccctgtctctactaaaaatgcaaacaacaaactagccaggcgtagtggtgggagcctgtaatcccagctactcaggaggctgaggcaggagaatcgcttgaacctaggaggccgaggttgcagtgagccgatatcgtgccattgcactccagcctgggcaagaagagtgaaactctaactcaaagataaataaacatgtgaaggagccaagtgtgaggagcttaagaggaagagcatggtaggcagaaggaacagagaaggcagaagccccgagatgacaatgagctgcatgttcaaggaatcagagcccgttatgggtggagcccagtgtgtcccacgagagtgcagagatgaggtctgaggaatgcacagggcaggtccaggggtacttgagggaacttaagataaggataagttagaagtttggaagccattagaaggtgttgaaaatagcatcaccattttattggaccttttttttttttttttttgagacagaatcttgctctgtcgcccaggctgaagtgcagtggcgcagtctcggctcactgcaaactctgcctctcagggtcaagcgattctcctgcctcagcctcccaagtagctgggattacaggcacccgccatcacgcccagctaatttttgtgtttttttagtagagacggggtttcatcatgttgggcaggttggtcttgaactcctgacctcaggtgatccacccacctcagcctcccaaagtgctgggattacaggcatgagccactcccggcccttattggactttttttttttttttgagacagagttttgctcttgttgcccaggctggagtgcaatggcacgatctcagctcactgcaacctccgcctccctggttcaagcgattctcctgcgtcagcctcccgagcatctggaattacaggcacgtgccaccacgcccagctaattttgtatttttagtagagatggggtttcttcatgttggccaggttggtctcgaactcctgacctctggtgacccacctgcctcggcctcccaaagtgctgggattacaggtgtgagccactgcacctggcccttattgaactttttaaaagctcatttggtttccttctggagattggattgtagggcaggggaaagtaggaccaggaacaacctatttgcaaagttggcgcaaacattcctgcctgacaggaccatggacacaggttgtagagatagagatggctctggctgtgcattcagcagattctgtagatagaattaataggacttggatgggattgtggtgagagaaagtgaaatgaaagataagttctagtttggaagttttaacaactgaatgtttaaactcaaatagacacaaaatattggaagagtggcaggtttgggaggatgagacaatcaactgtttggttgagccacgttaggtttgaaatgtctacgggactcccgtggggagaggttatatcagactggagcaccagagagaggccaaggctgatagtttagatgaaaagagagcatgatattttaagccctgagactggataatatcacctatagaaagactatatagagataagagaggtggggaacaagtaaaagctgcgggacactcctaaatttagagtcaaatttagagcagaaaatactagcaaaggggactgaaaagcggtggccaattgagcttcaaatgcaagtgaaagtgtgttgtgtgtacatttatcatctcatggcacaggaaaaacgtgatttaaggagaaggaagcgatccaatgggaagaagagatccaatggatcctctatcacgaagatattgagataagaaccaatatggatttgcacccactgcatttgcagccttgaggtcataagcatcctcaggaaaatgcaccaggtcagtgctaaggactggagtcaatacagactggattcaggagaaaaagtgaggcagggaatcaaagggagcaaacacagaaaactccttccaaaatctggctgcaaattcttttcatagaaagaattctctcaggagaaatagggttaacaccagaaaggaatatagtccaagatctttttggttgttttttgttttgttttttggggtggtttttattttgtttttgtttagttttgttgttgtttgtttgtttgtttttgagacggagtcactgttgcccaggctggagtgcagtggtgcgatctcagctcactgcaacctccgccttccggtgttcaagaggtcttcctgcctcagcttcccaagtagctgggattgcaagcgcgtgccatcacgtccagctaatttttgtatttttagtagagatgaggtttcaccatgttggccagtctggtctcaaactcctggcctcaagtgatccacttgcctcagcttccctaaatgttgggattacaggtgtgagccacggcacctggccaaggatggtttctttttaaagggaggggatatgatttatgtaatgtttatgtaatagtgagaatgatctagtagaaataaaatcttgagggtttgtttttggcagaaaatggaaggacaaatgcagggggaaagtttgtgggaagatgagagggcatcctgggccaatgcagggagggaaattattggaaagaacaagaagtctttattcacagtgacagaggcaggtagactgagggtcaggggaggaccggctgaaaatttcacatctagttattaccattttctcattataatgtcagtcaagggcatctgctgagagtgggaaaaacagagtaaatgaggtactttttggagaaagcaggactgaaataattaaggtgtgggatagcgagtgcgctggagaagtagagtaacctaatgaggaactgctgagttttcatttgaaatctgtggtcataaattcaattgcaaccctcgataattgtgaaagtcacttccgctctctgagccgtactttcctacctgttacacaaggacagcacttgtcccaaagcaagggtattgtaatcagagatgataaaatatatagtgactggcacatattaaggactcaccaaatagcagacctcataatcagtacaggtatcatctgtggttcgcagttctcctccttacattacaactagggtggacccaaaactttgcaatttttgccttgttaatttgtcctcacctgtcattgcacaatcatccttccttgttgcatcaacatttttttttttctgagacagagtctcgctctttcacccaggctggagtgctgtggcacgatcttggctcactgcaacctctgcctcccagactcaagtgattctcctgcctcagcctcccaagtaactgggattacaggcacccaccaccatgcccagctaatttttgtatttttagtagagacagggtttcaccatgttggccaggctggtttcaaattcctggcctcaagtgatccacctgtcttggcctcccaaagtgctaggattacaggcgtgagccactgcgcccagcctgtatcaacattttaaaatgaatttgaaattatggatagatcatgtcttctaagtgtcttgtagaatgtttggagtgtggatagagaaaatctgagtctgttgaggaactatggggtggaaaagggttaacagcacaattctgttgtaatcaatctggctgagctccaattctgtctctactctttctacctggtaacgttgaacaattaacgcagcccatctaagtcttaacttcctcatctgtacaatggttatactaattatcaggctgctgcaaaagtacttgtggtttttgatattattttcaatggcaaaaacagcgttacttttgcaccaacctaatatcactaagattaatcaatattcactgtgtctcaggagtgctcagtgttcacacatattaacacagcccatccacagatcctgtgagaggcgttgatagggttaaaggaaaagctcttggtgtgtgggtaatgttcataagtagaaacaactattgctatgagcatcgttcttgtcctgaccttgaacttcataatggattgagccccacgacacagcacacagcctggtgagggccaagagttcccatttgtcatagatatactcagtctagcctaaaagatttccacatctattctcacttaatcctcacctgaaagttagacttcaccataaaattgtcctcgttctgcagagcagaaaactgaggctcaaagagatatcactgactaaaaactcatagtgaggagacatcacagatgagattagaagagagatgtagctgacttcagagcccagtatatatatatattttagacagagtctcgctctgtcccccaggctggagtgcagtggcacggctcactgcaacctccgcctcccgggttcaagcgattctcctgcctcagcctcccgagtagctgggactgcaagtgcatgccaccaggcccggctaattttttgtattttcggtagagacggggcttcaccgtattgcccagggtggtctggaactcctgacctcaggcaatccaccccccttggcctcccaaagtgttgggattacaggcgtgagccaccgtatctggctgagcccagtattctttgtaacagtgactctcaattgggggtgactttgcctccgaggggacctttgacaatgtttatggaacctgttgattgtcatttctggagaaggagttgctactggtgtctgtggatagaggccaggggggctgctcaacatcctactgtgtccagaacagtctgccacaacgaagaattacccagacccagatgtcaaaggtgccaaggttgagaaaccctgagctacattaaataacgtcccatggaatacctcagtgaaactcactggtaatagcaggaagaaaaggaggaaataaggaaaaggaagaaggctaaaaatcaccagactgaggcatagccctatcctagtaatcttgggggaatccctttcaaaggcaggacttccgtatgcaaaggcagtggctctggagttgttcatctcggtttccgtatcttgctgcctccactgactggctgggcatgatgttgaaaaaaactacagaagtccccgggccatgaattcccccagatgtgatggctgtttcccaatgttattatgagcattagatgtgaacaagtgctatggaattgctatttctcttaaagatgctgaatagcccagtctgagatgattctcaaattctcatggccatagcaaatcatcctggcttttacacatacagattctagaatgagatttatggatataattgtttttcatttttattataagttcaggggtatatgtgcaggtttgttatacaggtaaacttgtatcctggtgttttcttgtacagattatttcatcactgagatattaagcctaatacccactacttatttttcctgatcctgtccctcccctcaccctccaccttccggtaggccccagtgttcccctctttgtgtccatgtgttctcatcatttacctcccatttgtaaatgagaacatgtggtatttggttttctgttcctgcattagtttgctaaggataatgaatacaattttaacaggcagcctggatgtttctgataaagtccacagaccacggcataagaaaatgtgctcaggtgacgtgggactttgtgttgaactggatacaaatattacagatgtgatccggaccagaggcagggactacatgttttgggtttttgttcttaaaagaaaaaaacaaaaacaaaaaaacttgatctgagaagctctgaagggtcatattcttacaatgttattgtccacaatttagtcacgtgtccactaccaaagcaatcccttgcaaagtaaaagggattctggttagtgctaattagactagtcaggatttactcccaacatggagaaaagacaccttctctgcagggtgagtaactaaacacaattgtggtttttcaagcagagaagaatggggaaccgttgctgggtgggcaaccagcaatatctgtcaagcgtaagggtttagaagtcagaccatgccaaactgaagtcctgaatctattatctactacctaagtgaccttcaacacatttcacaattgccctgagctttcatttattctaatgaaaactagaagtaatgaatattacatagctattacataggccaaaccggatcccatatgtagtaattaacacaatgcatagtctctaataagaacttcacaagtattaatacaacttattattcttatagtctttatcccacagacaccaaagctatacaaatcggcactgattatttgcattccaaacagagaagagctccacatcaagcagggacagggaaaagcagagggtagaaagcagagatggaactctctttgctgacttcctctagtgcagaatcctcaggatataacatactactacatgttaccagtgactcctcaaaattctcttcaacaataacctcaagccaaaccctcaaactttatcttgagtactagccaagcaataggtcaagggttctcacagtttgagggacaggagttgggagactggaagaacctggggctgaaagagattgcagagcttgccagcatgtttgcattgaatggtgggagacacagatgtgagccttctgattctgagtcatgtgccttcctcacaatgctgaggctgcctatgctcaattttccattgtccatacaacataagttcagtatgagccttgtaatcctcttggtgaagtgatcagcccgataagcgaaatgcatattgataatgatgggaatatggaggactatcccttcccaaaggagcatccaagagaatgccaattctatagcaccgttgtcaacaaggcttggtagatagagtgggtctcctggtaggagtgggagctttagtggaagttgatgtgagctataaatacagatgctgtaagatggttccacagctgagaaatggccattgttggaatgtttcaggtgctgctggcaagatggaaaccaacttctccactcctctgaatgaatatgaagaagtgtcctatgagtctgctggctacactgttctgcggatcctcccattggtggtgcttggggtcacctttgtcctcggggtcctgggcaatgggcttgtgatctgggtggctggattccggatgacacgcacagtcaccaccatctgttacctgaacctggccctggctgacttttctttcacggccacattaccattcctcattgtctccatggccatgggagaaaaatggccttttggctggttcctgtgtaagttaattcacatcgtggtggacatcaacctctttggaagtgtcttcttgattggtttcattgcactggaccgctgcatttgtgtcctgcatccagtctgggcccagaaccaccgcactgtgagtctggccatgaaggtgatcgtcggaccttggattcttgctctagtccttaccttgccagttttcctctttttgactacagtaactattccaaatggggacacatactgtactttcaactttgcatcctggggtggcacccctgaggagaggctgaaggtggccattaccatgctgacagccagagggattatccggtttgtcattggctttagcttgccgatgtccattgttgccatctgctatgggctcattgcagccaagatccacaaaaagggcatgattaaatccagccgtcccttacgggtcctcactgctgtggtggcttctttcttcatctgttggtttccctttcaactggttgcccttctgggcaccgtctggctcaaagagatgttgttctatggcaagtacaaaatcattgacatcctggttaacccaacgagctccctggccttcttcaacagctgcctcaaccccatgctttacgtctttgtgggccaagacttccgagagagactgatccactccctgcccaccagtctggagagggccctgtctgaggactcagccccaactaatgacacggctgccaattctgcttcacctcctgcagagactgagttacaggcaatgtgaggatggggtcagggatattttgagttctgttcatcctaccctaatgccagttccagcttcatctacccttgagtcatattgaggcattcaaggatgcacagctcaagtatttattcaggaaaaatgcttttgtgtccctgatttggggctaagaaatagacagtcaggctactaaaatattagtgttattttttgttttttgacttctgcctataccctggggtaagtggagttgggaaatacaagaagagaaagaccagtggggatttgtaagacttagatgagatagcgcataataaggggaagactttaaagtataaagtaaaatgtttgctgtaggttttttatagctattaaaaaaaatcagattatggaagttttcttctatttttagtttgctaagagttttctgtttctttttcttacatcatgagtggactttgcattttatcaaatgcattttctacatgtattaagatggtcatattattcttcttcttttatgtaaatcattataaataatgttcattaagttctgaatgttaaactactcttgaattcctggaataaaccacacttagtcctgatgtactttaaatatttatatctcacaggagttggttagaatttctgtgtttatgtttatatactgttatttcactttttctactatccttgctaagttttcatagaaaataaggaacaaagagaaacttgtaatggtctctgaaaaggaattgagaagtaattcctctgattctgttttctggtgttatatctttattaaatattcagaaaaattcaccagtgaa

SEQ ID NO: 38 - DNA, 14156 bp, Homo sapiens
ctcttttctaagcttgtctcttaaaacccactggacgttggcacagtgctgggatgactatggagacccaaatgtctcagaatgtatgtcccagaaacctgtggctgcttcaaccattgacagttttgctgctgctgggtgagtgagggtcattctgaaatggggcaatttcagacactcctactgcctggactccaggtaccagtgtggtaaggagcaggcctgggccctggaagcaggggatagattgaaagaggagagaggaccctgaattcttaagtgttccaatggttcctaaggtcagaactcagaggtagtttcatagtccctggaaagtccattctgcaccaaacattcatgtgtactttgtagtcatgaggaggaacaggaaatgagataaaggggacatatgaagtgaatacttttataaaagatcaactggaaacaggatcttgagatgggtcctggagaaggaagagcccaagctcacctccccagcatttcacatacgcagctaaatttgaagccgtgttctcctgctcgacgttgatccactctcttctcttttacagcttctgcagacagtcaagctggtgagtatgccctttgcttccttgtattgacagtgttgtatcctcataatatgatgctgtgtttgctggggcggcgggggggtatgtctattccactgaaaatcaagcttgggttcagcatgggcagttcccccattttagtggggtctgggatttgcttcttagatccactgaagacccaagggaatgaggccgctgcaagtacagatcttgaactacatctacaataggactcttgggtgcctgacctcccttgggagctcctttggcatccacagtcccttcagggttatttattccacacccctttccactctgcccctcagcagctcccccaaaggctgtgctgaaacttgagcccccgtggatcaacgtgctccaggaggactctgtgactctgacatgccagggggctcgcagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttccggtcagtggaggaaggccccagggtggacctgggagggccaggacggatgaaatctgtttacagacagaggtttgcaggaaagagtgggcgtggactgcttactgggaagcactgttgtgagttgctcattcattccccatttcacccaccctctttgcttagcatgcgtggtgggggaagggggaatttctaataattttctcagcatgtgttaggttgtttttgcctcagtcttgattgagcaagggggttacgaggccacaaacagctgagtgtgggagaagcagaaggaaatccctactttaaaaaactaccctcctcctgtggcaatgcggtaaagcagagaggttgggggaaatagacctctaaaggctctaaggcaggaggctgccagacaggtgtgtggaggtgggagtgtagaattcagtctggaagatgaggtcagaggtgaggggagggtgaagggtagatcaggcagaggctgataggctgttgcaactattttgacttttattcctgagtgagttgagatggctttaattaaaggagtcacgtgatctgatttagctttatgtaaacatctgacagtgttcagtttaatagagtctgtagagaaaatgcttctagatagtatttcttttttttttcccccaagtagctgggactccaggcacacaccaccatgccaagtgacttgtttttatttatttttatagagacagggtctcagtatgttgcccaggctggtcttcagctcctggcctcaagtgatcttccctcctcaggctctcaaagtattgggattataggcgtgagccaccacgcctggcttagatactgtttctacctgcttccaatgtctgaaaatataagcacatttctattgttgtttacttgagctgcactcttggtgcataaaccctggagatggtcacaggtaaacattcagtgttttagattctcctgttcaacactgaaagggtgatttgtttttgtggtcctttaaggctgctgctgtaccagagagatcctggctgtggagtcgctttctgttgatggtgctttactgaaggggaataaataaatattgagttgacctcaaaagctgcctaatgacatcatagctcctctctgtattggcttcccagagacagccgatagtaattctgactcttcttatgaaaatgtaaaaatatagataataaaaattgagggctgggtgtggtggctcatgcctgtaatcccagcactttgggaggctgaggcaggaggatcacctgaggttgggatttcgagaccagcctgaccaacatggagaaaccctgtttctactaaaaatacaaaattagccgggcatggtggcgcttgcctgtaatcccagctactcgggagactgaggcaggagaattgcttgaacctgggaggtggaggttgcggtgagccaagatcacaccactgcactccagcctgggcaacaagagtgaaactctgtctcaaaaaaaaaaaaaaaaaaaaaaaaaattgagatctgaagcattgttagagagaaactacctagtcccacctatccattgtacaaagaaatgcaactgattagacccaagagctcagcagttaatggcacagccaaaatcgcaatcctgactttagtttctgttttatgccatctcagtaatggtacctggcctttcatatacagaatactttttttttttggccaggcacagtggctcatgcctgtaatcccagcactttgggaggacgaggtggatggatcacttgaggtcgggagttcgagaccagcctggccaacatggaaaaaccccatctctactaaaaatacaaaattagccgggcgtgatggcgcatgcctgtaatccagctactcaggaggctgagggaggaggattgcttgaacttgggaggtggagtttgcagtgagccgagatcgcgccattccactccagcctgggcaataagagcgaaactccatctcaaaaaaaaaaaaaagaaaaagaaaactgtttttttaaatgaatttttatttaaataagatcgaataaattatatttattcctatgatacagcaatttgattttcatctttattaagtctattgaaactttgttaatagatttgtcctccgaggtagctgaattttggaatctgattactctgccatcagtgaagggaaggaattgttgggagtgaggatgtttgtaggcaaaaaggaaaaagtgattttaaatttaaaatttttcttgaatgccccttttattcagagtcacaaatgaatactgaattcacctgtgtgaattcaagtcatgcctttttatttcttatgtggatggaagattttatgcagggtacagtatggtctgaatgtttctgtgcccccaaaattcatatgatatgaattaatcaaatagcaacccccagggtgatggtattaggaggtgaggtctttgggtaggtgattaggtcatgagggcagagcccttataaaagagggccgagggagctcaaaggcctcttccgccatgtgaggacacagtaagaagcctcagttctgtgaaccaagaagtaggctcttatcaaagaagctgtaagcaccttgatcttggactttccagcccccagaacagggagaaataaatttctgttgtttataaaccacccagtttatagcattttgttatagcagccagaacagactaagacagggtggatgagggatgattaaggctctatttttttttttttttaaccagcaacagcatgtggaaaaaaggggggaagaaggctctacttctttgctaatacagttcaaggctgcccaccctcacttcccaaagcttgtacaaaatttaccattaaattagtaatccccagaccacaaaaactgacggcttcaggccctgtcgagtagcctctacagttactgaaatgcgctcatttctctactcaaacgtagtattttaaattcctcagaattgttttaaatatctgctctgcatctttgaaacctctgaaaacttctgcttttagaagtcccacagatataataccatatattgcctataagagaatgctcacatctgtcatgaagcatcttcatttctgtctgccagacatcatgtcaagttctgtgagtaacgtacctctgagactgaaaaacccttggaatctatccttacaactttttcttatcatatttgtgtctttcagaatggctggtgctccagacccctcacctggagttccaggagggagaaaccatcatgctgaggtgccacagctggaaggacaagcctctggtcaaggtcacattcttccagaatggaaaatcccagaaattctcccatttggatcccaccttctccatcccacaagcaaaccacagtcacagtggtgattaccactgcacaggaaacataggctacacgctgttctcatccaagcctgtgaccatcactgtccaaggtatggggagtctgccaagatgtagggaggggagaagaggggatggacaagggctgaggtcacatgggcctacatggaggtctgagaaagcccatagcagcaaaattgggcactggagcaaagaggagtggggtggaagcctggctaagtattgaccaacaagtaggggccagagcttggagccctcacgtcccaggtaataggtagtcaggctgttgtttcactttgaaatgtaggccccagactaaagatggcagtgaagcagagctccctcattgatgcagaggttccctaagctcctgggcattcctaagagctgaggtttgcctcgtttcttctcatggctcatgttatagccattcactccagaaagcctggcacgtcatggactgttcaaggctgtgctccatagagtaatgatgcctccagctatgcgaggctttgggcccaccctccgtactgtccccaggggctaaggggaatccttccctctgctcctgcatgctcaccagtgtgctttcattcatttggtggagaaacctgggtagggaggaggcacaagtccagccacagaaaccctgtgccagtgaggctggggatgtggtgaatcttgcattggtgagtgactcagacacagaagagcttcaggtgacaagcactgggacatagcattggaggtgggaggtgggacagggagaatacaaacgttgtcattaaaatagtaaccccccatcctgccctaatgtctgtcttccctagtgcccagcatgggcagctcttcaccaatggggatcattgtggctgtggtcattgcgactgctgtagcagccattgttgctgctgtagtggccttgatctactgcaggaaaaagcggatttcaggtttgtagctcctcccagtcccttttgttatcagtttccatttggcccagggcctaaccccagacattgccagaatcccgctcttagggctagatatgcattccgatctaggcccaccttttatttattagttcatttattagttcatcctcaacaagagcactaataggagtcacctcacagggttgccatggggatgaaagaggctgatgctcttacaccagtgcctggtaggcagtaacagcacacaaacagggctgttgccattctggaggaggtggtatgtgagggcagcgcttagctagggaaggaggactctccaggcactgggccaaggcagggactgaggctgggtggggcttatatgaggggggagtagatagggtactgcaagcctctgagaaagagaaataatcccactaacacctcacaaagcactttgcaattggttcatagccaacacctcagttactgatgataagtaaatacagagaaacagagagagagagaggcagactgtgagacacaggggtgtttttaaaaggcagagcaagcctcagacagatgccatggcgtggcctttctgacactcctgggcgtccccatgggtgagctgaattctgcctctggactagcccttttccaggtgggagcagcccctgagcaggggaactgggggtgggaggacaggaaacatctgccagagggaaggcctgagctggtcccatccaatcctggccctggtccttggtcctgaggactcaggccccactgcctaatcctgctaacctcctgtgtgtccctcccagctctcccaggagaccctgagtgcagggaaatgggagagaccctccctgagaaaccaggtgaatacagagttgtctcagggattcagtgatggctcaccagggctgccggctggacctgagccagcgagaaggggcttgtgcgagttcagctgggagccagggagggagcagcgatggggggatggccagggctcaaatcgcttggtcaactctgagtctaatttctgggcctaaagaggacctcgctggagatgagaagagaaacaccagtcccagatacagaggagagggcggtgttcaaatttctaggaccaggaatctggtgatatttccagagcaagaaatcagagatactttggtctttctgtggagctttggcagagctggcagaggatggggttaggggctgtaagactgaggccaatcggacgtgggaggcaggagtctaaggggaaaggaggaggaggcctggaaacccctcaatttgctgaggaatctgcctctgtggagggatggggtggagtggccaggctcagctgtctgtggaacactaagaggaggtttgggcttgagaaaattctggggggctaggggcactagtgggctctactctgtgggcaaagctcggttccaatgcccatgcactcaaggttgactgaattttggcctggttctgcccccatcacacagtggagccctgagcaagtcagtctccctgatggggttcagtctcctcactgaggaaatgagtgggtggccagggtgacctctcaggccttctaggtctgacattcaggtgggagtatgtaaaggaacttccaggaggatgccaggcaacttccagactgtagttaaagtcagagcataaaggaaaccagtgctttctctgggggcttccatgacagtaggaacaggcaggaaaaaggctgtcaaagaccgcacctcagatggctggagtatgatttagagcagagccaacagatttaagagcttgagcaaaatatcacttgttcagctgtgcttgcagcaaggttgcacgtccactggccaggcccagtggtgataggggcctgtgttcacaccagggccaaagcagatctggaaaatacaaagtccaagcaactggattatccgtcttgttgtgtggttctgtctacactggcataagcacacttcacgaggcacttttgcagccaggcatgggggctgcataaatggttttttaaaaatcctttcgcaaaaggcaaagctgggttgctggaattgttggggaatgtattagaatgggaattcagaatgtggtttgctgcagaatttacagcatggcaataaaggctctctgtgttcagggggtgagagaagagactagatgcattgtctcagatgtctcccgacttcctgagaaatgccactttgcaaatactggggctacttttcacactggccaagtcagtttatgacaaaaacatgaggcaattaggtgtgttttggacactaaccagagaaagtccttccttccctcccttcctccctccctccttccctccctctctcccttcctgccttccttccttcccccttccctccctccctttctccctccctaagctccctccctgcctctctttttctctctcatgttactttctctttctgtcttcctttttaatgccatggagtactatattcttcaaagttccaacaaagatgcactacatttggacaatgtggaaatggccctcagccttctcttcctgatgtggtcagcaaaaatctggactttacttcactctgatgctgaacaccctgctccacgtcttccccagtatctcagatccccaagctgtctggtttgcttctaggaaagctcagcaattccctgaaaagagtgtggcccaagtgactgcttccctccaccagtgtggcccatggggaaggcttgtggctgggtgaccccaagggtgggtacatgaggccatatttacttagcccttggccttacaggactgtgtcaaggggtcagcagtccttgctttgagtctggttatggttttgcagcctcagcatcagcgtgggcaggcccttttcaacagcagtgccctggctaatctttttctttttccccacagccaattccactgatcctgtgaaggctgcccaatttgaggtgagtaatcccagccatctccttttcctcctgccttgtcccttctctcctgtttcctctcatttttgcctttgttaatgcaaaattaaaatggagactgggcctgaaaactcctgagcaaacaaagccacccaggccttagaaatagccttatcattgcttaaactgcaaacataagtgaaactcaagttggattgtaactaaaaataggtaatacttaacttggatcatttctggtaaatgtttatgttagacagaaataagatttaaccctagccaatcgtaagcagccaactaacataattatgtgactaagaacacttcagtaaggtacctcacccaaaagacaattatgtaactgcaaacctatcaaatttctttatttttcttccacattttccaaattaatacttgtctctgactttctgtcattaaaacattagacctcttttggtttggtgtcacccaattcatgaattgcttcttattcaaatgaactctttaaaattgtattgtgccttagatttttctttaacagtttggtgtcagaagtaggatataaagtagaatctcccccaaagatccctaagagcaatgggtgaccaggcataggtacccattaagcccattgtgttcactggtttcttcctgcatttgtgagtcactaggtaagtccctctcagatatcaggcttgcaacttgtgtcctgagctctctgagtttatttgagtaattttatttctcatttgattcagcagttaatcttggtatttgacaagttcatctgtttccaacaggaactatactaggtccagtatagtgtactagtttccagacaaggtctgatttctggattgggatccagaggtcaaattgggtacttgacagattgaactaggtgttcaacagaaaccgaactgggggtccagttggagtcctcaggtaggtaaatttcagaagggcaagatattatggctttgtcagaatgtacagagtctgggactcctccatctgaaacacagtgatttctatgttcagataatatgggcccagaacctgtgactttctagagaaataggtgtgccttacctattgagccttaccagagatgacttaaagttgcaatggtcacagtgaggatgtttaaatctagaaaaaattgttcatttaagggatgcattgggaaaaaatgagatcccaaatgtctcagaaacaatgataaataattttgattggtatgtaaaggtttctaaaagaatgatttaaaaaaatagtctctctaagtaaatctttacaatgtgctaataagaaagtattctaaacctattaacctctttgattgcttgctttttccatctgaacctactcaatgctaacgtccttaaaaaattagatcctcaaatgagccaggagtatctacaacaactaaatttaactcttgttattgcacacatgaactattataaaagcaaccactaaggctaaaaataataaaaactaattggaaataggccagataaactaggtgtctcgttagtcactcatttaaaatttaatccagtctcaataagattgactcctaataataggtgaaaatgccccaaaactccttcttggagaagcttcgtaccctttctctgggcctttgagttgtgtaaatgtttttaaaacacaagcttcagcaaaatgactcatcaaaaagaaaaaaggaggaattttttagaaacaaactggcaaatgaaaaatcttaatagtcctctccacaaatatcaataaaaagtgccagccatcagaacagctaactttaactagaggctagatccaactaattagttttatattattatacctggcacatggctaaaatttcagaacaaaagccatgaatttctgtttgcatctttctgtatgtttacatatatctacacatgtgtatgctatttgtacataatattattctacctccagatggtatttattagaaacagtattaaaggagctcaactggcctagagaaaaataagcacttatataaattacatattttctcagaagaaaagaactttgccaaaatgcttttcaacttcatatgacctgagtaatctttaataaatgagaatattggtattaatgaaagtgaatattccacctagttttacccaaataagctcatgttgtctgctatacaatttgtcaaaaaaataccttgagatgacaggtagttggttttgttaatattatgtttgccactttaactatgttaaatgaaatgacaggtattcattaaatatctacaccatttccagataagacaaactactaaaacaaaaataaaaaagtgttccacttatctttttctctctacctgattgtttcagaatttggaaactcttattaagtatttttattttcaatctgggtatttgcataggttcaataagaatctattctccttgtaacaggacataattgggcaagtccttggcttggcttcttagcctagagaggcttttaaaggtctaatctgagatttctcaattactagatagtttttaaaaactaaagttgactgataaaaagtcagtaaagtctcttggatatcaccaaagctgtggctaaaatatattttaaaattactgtttttattatacctatataaataatcaggtcaaatttaatgaaactagatttatttttgcaaaaaagttaactttgattttcggtaaaaatggaaaataaaaatatttttctccagaataaaaaagattatattttagtagaaaactattgtgcatccattgtcaaattctaggcctgttcattttctttgaagttttattatctccctataaaccagattgactcctgaatttttgttttttagttccactaaaaactaaaactgcccttttccaaagctctgcaaactgaaactggtgactttaagcttcagaaaaatcactgcaacagagcacttatgccttaatgccaatcttaatgcctgctgctatctgggtcactcagagagtttaccagaatgtttaatgaaataaccagagacattcaaattgcaaaccagtaaagcacatcacattgcaactgctatcttcagtctaccatttaaacttgcctcaaactcacctctagaaattgtttcacctagctgccctctaaactcaaaaactaagatcataatttgctccaaatattaactttgtttttttaatagaagaatactctgaattcctttcaagcaatacaatctaaaatgagcaagttagcctcaatagcaccccaaaatagaagttcttgatatcttaacagcttaacaaggaggagcttgtgttcctactgatgtcaaaagaaatggttgaagatctcagctggctttatggtgattctagaactgggcaacacttgcctccttaaattagaataaggtttccaatgagttacagcagaggagattggcttcatagacagaaaaaggtctgaagaaagcagaaacaaagaatttaaagtggattggctattttaaaactggttaaagttgcaaaagacaggaataggaaaacagaataataaataactggttggttaacatcaggttactcttttgtaaggatgccaattgaaactggcctgtttgggaaattagatttttaggttattaggttattatctctctctcctgatttttccaaaggccagataagaatgtagtttctgtttgatgacttgaaactttatcatgggtgattccactttgatttttagtctgttctgtttgggcctagtgcaggagcttagtgcaaaacaatagcctcctaaaatttaaaagactttaaagaacatacatgagtttttcatcagataatatttatttgtattcattaatttatttgattggttaagtcttggctcccgagaatctttgctcagaggaatttttcaatccttggctattattctccttatagttattgtatttacctccccggtgtattgaattatcctatgggttttaaatgctttcctgcagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatactctcagcttgctgagtggatgacaaaaagaggggaattgttaaaggaaaatttaaatggagactggaaaaatcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtgactagggactttctaagaagatacctacccccaaaaaacaattatgtaattgaaaaccaaccgattgcctttattttgcttccacattttcccaataaatacttgcctgtgacattttgccactggaacactaaacttcatgaattgcgcctcagatttttcctttaacatcttttttttttttgacagagtctcaatctgttacccaggctggagtgcagtggtgctatcttggctcactgcaaacccgcctcccaggtttaagcgattctcatgcctcagcctcccagtagctgggattagaggcatgtgccatcatacccagctaatttttgtattttttattttttttttttagtagagacagggtttcgcaatgttggccaggccgatctcgaacttctggcctctagcgatctgcccgcctcggcctcccaaagtgctgggatgaccagcatcagccccaatgtccagcctctttaacatcttctttcctatgccctctctgtggatccctactgctggtttctgccttctccatgctgagaacaaaatcacctattcactgcttatgcagtcggaagctccagaagaacaaagagcccaattaccagaaccacattaagtctccattgttttgccttgggatttgagaagagaattagagaggtgaggatctggtatttcctggactaaattccccttggggaagacgaagggatgctgcagttccaaaagagaaggactcttccagagtcatctacctgagtcccaaagctccctgtcctgaaagccacagacaatatggtcccaaatgactgactgcaccttctgtgcctcagccgttcttgacatcaagaatcttctgttccacatccacacagccaatacaattagtcaaaccactgttattaacagatgtagcaacatgagaaacgcttatgttacaggttacatgagagcaatcatgtaagtctatatgacttcagaaatgttaaaatagactaacctctaacaacaaattaaaagtgattgtttcaaggtgatgcaattattgatgacctattttatttttctataatgatcatatattacctttgtaataaaacattataaccaaaaca

SEQ ID NO: 39 - DNA, 15540 bp, Homo sapiens
agaacatttctttttcacttcccctttcagactccagaatttgtttgccctctagggtagaatccgccaagctttgagagaaggctgtgactgctgtgctctgggcgccagctcgctccagggagtgatgggaatcctgtcattcttacctgtccttgccactgagagtgactgggctgactgcaagtccccccagccttggggtcatatgcttctgtggacagctgtgctattcctgggtgagtcagggcccccaggagggagagaggaacgggaacctcagttggggataaccctgggcaaggatgaggggtggcatgggaagaccgtcaggacacccaggggagggaaggcaggctggtgaagatgaaaccctgatgactctgctggctttggaaagtcatccaatgtggcagagttcagggttttttcagtgtctttcacccaatcttactgaacacccagactcttgatgttctgttgctttccacatcagaacccgctctgagaaaagtctagtaacctatacttgaatgataaatgaatggccagagtgtttgccttctttgaaatttatgcttcacaaaagaccaaatcttaggcaggagggccagtgctgccttgggtaaggggtagggaggaagttgtaagatgcatttttgggaggaggtggcagtggccattctctgtgcccctgaaaccactttgtgtagcagaagcctattgtcttcatgtgtaagaatattcccctaggcagaagcacagggagatctgggttatccagggaaaagggactctgagaatacaaaaacctgggtaagtctggagtcatctgttgtgggaccagagaaatcatgcatgctgcttttgaccacacagaccatgatggggaagtactgcatctgatcagcaagagagacagggtctttggccaaaatggagggctcttttctaaccatgttctcagctgttggataggggacgacgactgattttgctgagtggtttgaaaagcctaggggaggccaagtaggggagacttactgccaggactatctctccaagctcagttcctggggcttccaccctcacattctagaggaaagcatattgccactcagccaagttgtgtgatgtgattactagtgaaacgtgatcagctctgggggccctcggctcttggctgtcaatgcaggatgatactgggctacaggagaaagaggtaaggaagacagagtattcccccatgaataggatggaatggattaaagtagaagagaaagtaaagtgaactacctcatttgtcatgtggggaagttcaggcctagagaggtgatgtgcttctctaccacctgggcaagactcctgggaaagatctttggtattttttcccatttgccttttactaagtcatcaaagatttaccccattttttccattcttattggggctgccacatttacgtcttcatcacttgataactcaatttttatagcaccctctgatggggtcttgattgatcctgtctcccctcccctgcatccatgctgcccaccaaggccacggcatcttcaggtccagctatggctgtgtcagtgcatttaataaatgccttccgtgctgctccattgcccactgcaaaaactctaattctgccctgcacactgtgttctccattgcaccccacatgaatcttcttctacagccaggcagtatgtacactgcactttctgtttttaccacctttgctcctgctgactctccaaattctatgtgcaggcactgttctaggacttggagacttatcagtgaacatgactgacagccttcctgaccggaaatacgaggtcaatgaacttattgtgaagcaataagtacaccgggtgggaggatatttggtatttactactatttattaactgtggaatggatacataattggtgacttctctctcctttcctcatcttttccttttttttctctcgctcttcctcttcttttttactctctctcccactacaccgtcccccttgccaatcttacatactcaggtttttagctaccacttctatgtcaataactcctaaacctatttctcttgcttgcttctgtcaagtataattttatatttccactgctggttggacacctctaaaatgattctccagctcaaaaacaaagcatattcaaaatgcaacttatcatctcctccttacaaatgttctcttcctcctaacatttgtatttgcgtaagcgcagccacccttttcctagttatccaacttaaatcacccccacagtctattaaatgccaacttctctctgccacttaaatttcttctgcatctgtttcctcttcttcacctcctattgtcagtacaactttgggctctcttatctcccacctagattcaaccagtgaatgatttccagagcaatggcacatcaaattaatatggctactgctctctttgaatttatattctactgagggatataaacggtaagtaaacaaacaagaaggcataagtacaaatggaaaagggctatgaagatgtaaacggggtactgtgataagattagttgtggggaagagaagagagcagcccactttaaacaggatgttatgtaaagagttttctgagggggtgacatttaagctgagactttcaacatggtaaggattcagccatttggtgatcaaggacgcatttcagggtagagggattggcatacagaaaatccccaaatttgaagaatgccaggaaggccagtgttaatgaggctcaatgagtaggtgaaaagggatctgagctgaggctggagaaggaagcacggacccaatttgatagggcttgcaggccatttccattttattttaagaccaaagaaaggcaactgaaggcttgtaagttggggagtgatatcatctgatttcgttttttttttttttttaaggaactagcttctttatggaaaatggattgtagggtgaccataagaagtgaggggacaaattaagatatgggaaaaagctgatggtgacttaaactgagtagtgtctataaagggggtgaagagaagttagtgggtgcaagatctaagttggaagcaggatcaacaagacttcctggtgtggaagggactggattttgggagacagagaggttaaaagatggcttgcaggtttctggcctatgtagctgggtggataacgaagatacatattgacatggggaagacggagagaaacagaatgtgtccacttgctatgacaacatgaagccattggtgattttgacaagaaaagttttagtggactgctgagggccgagtccaaattgcagagaattagacagtgaatgagaggagaagaaatcaggacagcctatgtaagaaaaacaatggagaaatttagttttgaaagggatgagacaggccaggcacagtggctcatgcctgtaatcccaacacttggagaggccgaggtgggtggatcacttaaggtcaggagttcaagaccagcttggccaacatggtgaaacaccatctctactaaaaatacaaaaattagccggatgtggtggtaatacaaaagttagccgggcgtggtggtgcatgcctgtaatcccagctgcttgggaagctgaggcaggagaattgcttgaatctgggaggcggaggtcgtagtgcactgagatggtgccgctgcactccagcctgggtgaagcaaacaacaacaacaacaaaaaccgagagaaatggggcagtagctggaattatatgtggtgtcaaggaaaagtttttttttgttttttgtttttaatggaagatactgaaataaatttaccattgatgggaagatccagctaagagagaaactggtgatgcagaggagaaagtgaataacagaaagggaaatctttgagaggattaaagggaatgggatccagagtacttgctttgagactgaccatagacaggaggagagatgctttctccagtgaaatgcgaggaaggagaagacaggtagagatgcagaaaagactggtagatttagtcgggggacgatgtgagatcttctgtgtaacctcttttgttttctctgtgaaatatgaggaaaggcatcagctaaaaatgagagaggactggaggcagagggtgggatgagaaagcttggggaatgaggaaaagatgagtgtcactactcagagtagcagagcaaatttcttggaaaaaagtgccacaatggcagttcagtgtccttttgaatgcggtgatcgcacatttactgcgtcaacagtttgccttcttgtgtggtaatttcaataacacgcagctgagcaagtaaaggcatggcgaatacaggtgcatttggtagagacagagaaaggcaacgaagttaaggggatttgcaaggaggtaattataatgatgcctcattgaattcaagctagatgggggagggtgggaggtaaaggcaaacatgtgctcaaggataggcagtggtaagatggatgctttggggttcttgataaggtcaaagattattctggtggctgtacttgagcagagaaagttcatctccaaagaaagaaagtttactgatgatgagcagttcagggaatgaagaggccagttgtttgatgggttatccacatattctggatcactacagtcatctcttttttttttctttttctttttctctgacctcattcttccatcacaattagtttctttcttaattaagctctttggcatttgccctgttccaatctatttgacactgcactttcagccccaatttgaaaattctaagtgacttcccactgtatactgaaccaaggagtgaacttataaaaaaaaacttaaatttatttgaaattcaccatgtgtcatgtagcacactaaatgccttctctggattatctcatttaatcctaacaaccaccctatgaggtagatactgctgtcattatcttcatttacaagcaaggaaactgaagcagagaaaagttaagtaatttgtgaaaggtcacttagcagtagcggagtcagcatttaaactcagtatgtgctttcccccactgccacaccacctggcactaggagccctccagagtatgacttctaccttgctttcctgctttgtccctcattattggaagtgcttgaggagagaccagaaatcaagtagaagttgggctgcaacttgctgggaatgttgccaagtacttgctgctccttcccatggaataccttttccctctcagccaaaatcctatcagtcctggaaggtccttgatgaacctgaaaggtcccatcttctccataggattcccctccttatgaaccccaaaccctcccaaacacagagccctgggatcttttctttctctgaacctccatagcattttatccaaattcctctaatgtcatctcttttacatcagattacacatgtgcttatctccaccgttagattcttgccttcagtggaagtagggacttaacgttcttttcccttaggtgaactcagcatgcattgcagggcagtaggaagccaatgcaggtttgttgattaattttggatgcaaaggaaggaagtgattggtccaagtgtatatttcgagatattggagcatcgggaccagaatccagttctgtaaactttgaagccaacactttctccacattgctccctttttacctcttggttctgattccatttccttccgtacttttgtccctgaaaatatacatgcacttggaagcttcttgactttctctcagcccagatgcaagagaaaaccttcacccatggacagatggacacacacacacatacacacacacacacacacagagctctgattcacctaaggacccagctttgcttctttacccaataacagcacccacaaatctttatctaccctagcccacactttgcctccactacggaagctcttttcttaacccagtggcatccccctacccctgcatgaagtcacagatctagtgcccttttgcagtctcttcttccttttatcagatatttctaatagcaaaaatctggaagacctaaatgccaagcaaaagagttgttaaataaatcacaggacagccaaatagtaggatatagtgtagccatttaaaatgacaacatgggcggggaacggtggctcacacctgtaatcccagaattttgggaggctgaggtgggtagatcacttgaggtcaggagttccagaccagcctggccaacatggtgaaaccccttctctactaaaaatacaaaacttagctgggtgtggtggcgcgggcctgtaatcccagctcttgggaggctgaggcaggtgaatcacttgaacctgggaggcggaggttgcagtgagccaagatcgcgttattgcactccagcctgggtgacagagtgagaccctgtccccccacaaaataaaataaaataaaataaaataaaataaaataaaataaaataaaatgacaacatagaaacagattcatcttctagaacttgcattgctcagtgaagaatcaggttaaagaacagtttttagagtatatcctcatttacacttatgtatgtctgtatgtgaacagcgtgtgtctgtgtgtgatcacagaaagaaatccaacaggatgtatgccaaggtgataatattttgctcctgcgtattttctatttttctgtagtgatcatggattacctgtgcaatttctaccccctcccaacaaaagaacaaatcttgctctcaggataaactctggcaaaattatttatactgatgcataaatcatatgtaaagcccaacagagacctctttccagaggcatatttattttaatcagtcaagaggggtaagccaaaggaaaatgccacaaaacaggtggaagagggtgttatatacttttatttcatttttgtatgttactgggagttctcagtccttttaaaagtgcagctcatccaggcagtcccaggggatatggccacgagggctgtgctgtaggtgaagggcgctctgggcctgggcagtctctgggccaaagtgggcaggtgtcagttcagacactccactgtgggctgatctttgctttctgtcttacagctcctgttgctgggacacctggtaagtactccacccacagcctttccttccctcgggtccccttttcctctcctcccagtgccctgtctggaggtgctctaaatgcaccagcaactgagcccagtaccaagtcagggccaggaaagggtaattgctcccgaaagatcccctctccctcttccactctcctccttccttttcctccttccacggaggcaagtggtaggcagccacggtgttcaaatgggggagctgtcacagaaaatgagaactctgatctctctctcaactgccttccgctgtccaaataaaaccaagggcttcctctctccaaataaaattcaggcacatgcaaaatcacatggcctgcatatgttgtccccctgtgttgctaaatccttgactgtgcatgtttctgagagctccaaggcctgttccctgacagagtggtctctgcatacctctggctacactttgccgggcacttctgtgtttgtgccactcagcctccaccgctccaggactggccctccggcttttctccctctctctttatccttctgaggccagagaggctcgtgtatgcttgggtgtgaggacgggccatcttgacctcgtttttaaagtatacagaatgacattaggtcagaacggaaacctgatatccaactcccatgcctgccatctccaccagagcccccacttatcttcagccagccccaggggaaatttatccactagtgtctaaatgcctttgtttatcggggagaaaagttagtctcgaaagagtatgtatgtatggggtgtctgtgtgtctgtgctggtggggagaggttggtggggagagagagaaagaactggtgaggatatctcaggtaaagtatatgtatttcgagggtgtttctcttgcctgctccctccttcttccctgttgccctgtcggagtcctgggctccctggggccgttgtggtgggatgtatgagcaaaagcaactgccttcagttgcagaaccattctgggcctggctcggcttttggtgcccctagtaggcctacaggtgcttttttgtctgagattcagggcctctcaagctcctgggcttcctcttcttcatgctacctcctctctctgcccctcagcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctggtcagtggaggaaggccccagggtggacctgggagggccaggacggatgaaatctgctttcaggcagaggtttgcaggaaaggggggtggcctgcttactgggaagtatcgctgtgagttgcctcagcacatatcagtggttgtttttgcctcagttctgattgaacagaagaaggtttcaaggccaaaaacaggcagccaagtgtgagagaagcagaaggaaatccctactgcataaaacccatttccattttaatggcagaattgaaaagcacagaccacaactgaatcctagccctggaaatgactcactatacaacatgatgaattcatttaacccttgagtttccatttcttcacctgctccgtggggcactaacgcctccctcagaggcttctggtgagaatcagtgtttccctgcccccgccccgccctccatgccccttctccacgttctcactgtgctaggtgctcttctctgtctttctcttccaccagcctgtgggaaacctgagatgaaagtcgtgtcttacccatctttgtatttccagcatctgaaactgggcagagcttaataaatattttgctggagaggttgatgatcttacaaagctcccattgaaaggtggctctctgtaaagcaaagttacaatgagattgtgatgaacattgtccttgtggcttttcacttagtcccctcccttcacctgaagagcaaattttcctcaaaagtacacagcaaacgaatgacccactggtgacactgctgcctttagaccctgctggaaagaagctccacatttattaacattcccgaagtaaatttatcaggtagcattcatcaggtaacatttgttgcacattcatgacttttctactgtccacaaaggcatatgtccttatcatatgcggactcctcggtcacactggattcttccttccctcctcgacatggaagagatggcatcttagggtctcttgtgttcttcctgcagaggcctgtcgggcaggaaaaggctgcagctgccttcctgggagaaggaggagatgagtgtatcctgaacacctattatgtgctaggggctattgtagatacatgacactatcatgctcattttcacgaatgaggaaactgaggctcagaagacttaaattatttgcccaagagttcataaatgacagagccagcattagagtccaggactgtctgatttcagacctaagctgttccctctgcacatcgtgtcccaccagtaaggaagatctgggtctcagagctgagccaagacctcccgggtcctctgcggttttttgtgtctttcagagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaaggtatgcggagtctgccaagatgtaaggaggggagaagaggggatggacaagggctgaggtcacatgggcctacatggaggtctgagaaaggccacagcgcaaaattgggcactggagcaaagaggagtggtgtggaggcctggctaagtattgaccaatgagcaggagtaggggccagagcttggagccctcaggtgataggtgaccaggctgttgttccactttgaaatgcaggccccagactaaggacggcagcgaagcagagctccctcgttggtgcagaggttccctaagctcctgggcattcctaagaactgaggtttgcctttattcttctcatggctcatgttacagccattcactccagaaagcctggcacgtcatggaccgttcaaggctgtgctccatagagtaatgatgcctccagctatgcgaggctttgggcccacccttcccactgcccctgagggctaaggggagcccttccctctgttcctgcctgctcacaaatgtacctttattagtttggtggagaaacctcggtaagcaggaggcataagtccagccacagaaaccctgtgcagatgaggctggggatgtagtgagtgctgcagaagtgagtgactcagacacagaagagcttcgggtgacaagcactaggacatagcattggatgggggggaggtgggacaaggagagtactgcctgtcctgatgtctgtcttccctagctcccagctcttcaccgatggggatcattgtggctgtggtcactgggattgctgtagcggccattgttgctgctgtagtggccttgatctactgcaggaaaaagcggatttcaggtttgtagctcctcccggtccctttggttatcagtttccacttggcccaggccctaaccccagacattgccagaatccctctctttgggctagatacacattcagatctaggcccgtattgtattatagtcattcattcgtttattagatcattcatttgacaagacttgaacaaactagcttatgtgtcagccaatgcgtgagacatggtgggtgatgccaagagaagtccagtccctgcccttggggagttctcagcattgtgaggaagacagggtcattataataagatgggataagagcaatgatagggacatgaaaagcctaggatagaagtacagaggaggctccatagcccaacaagggctgaggcagttggagaaggtcttggggagagcagtgtagtgtagtgatggagtgcacatagtggggccagactgcctgagttcaaatctagttctacagcataccaactatatgacccaagtgagtcactccacctctctgtgcctcagctgtctcaagtggaaaatggggacactaataggacttacctcagagggttgccatggggatgaaagaggctgatgctcttacacagtgcctggtaggcagtaacagcacacaaacagggctgttgccattctggaggaggtggtgtgtgagggcagcgcttagctagggaaggaggaccctccaggcactgggccaaggcagggattgaagccgggtggggctcatatgggtgtcgaagggggagtagagagggtactgcaagccaccaagaaagaaagaatcctgctaacacctcacaaagcacttttcaattggttcatagccaacacctcagttactgatgataagtaaatacagagaaacagagagagagagactgagacacaggggtgtttttaaaaggcagagcaagcctcagacagatgccatggcgtggactttctgacactcctgggcatccccatgggtgagctgaattctgcctctggaccagcccttttccaggcgggagcagcctctgagcaggggagctgggggtgggaggacaggaaacatctgccagagtgaaggcctgagctggtcccatccaaccctggccctggtccttggtcctgaggactcaggccccaccgcctaatcctactaacctcctgtgtgcccctcccagctctcccaggataccctgagtgcagggaaatgggagagaccctccctgagaaaccaggtgagtacaggttgtctcagggattcagtgatggctcaccagggctgccggctggactggagccagggagaaggggcttgtgcaagttcagctgggagccagggagggagcagcagtgggaggatggctggggctcaaatcgcttggtcagctcttagtctaactcctgggcctaaagacgacctctctggagatgagaagagaaacaccagtcccagatacagaagagagggctgtgtccgaatttctggtaccaggaatctggtgatatttccagagcaagaaatcagagatactttggtcttcctgtggagctttggcagagctggcaaaggatggggttaggggctgtaagactgaggccaataggacgtgggaggcaggagtctaaggggaaaggaggaggaggcctggaaaccccttgatttgctgaggaatctgcctctgtggagggatggggtggagtggccaggctcagctgtctgtggaacactaggaggaggtttgggcttgagaaaattctgggggactaggggcactagtgggctctactctgtgggcaaaactcagttctgatgcccatgcactcaaggttgactgaattttggcctggttctgccctcatcacacagtggagccctgagcaagtcagtctccctgatggggttcagtctcctcactgaggaaatgagtgggtggccagggtgacctctcaggtcttctagatttgacattctgagaaccaggggccacccaagccctggcccaggtgggagtgtgtaaaggaacttccaggaggatgccaggcaacttccagactgtagttaaagtcagagcacaaaggaaaccagtgctttctctgggggcttccatgacagtaagaacaggcagaaaaaagaggctgtcaaagaccccacctcagatggctggagtatgattcagagcagagccaacagatttaagagcttgagcaaaatatcacttgttcagctgtgcttgcagcaaggtcgcatgtctgctggccaggcccagtggtgataggggcctgtgttcacaccagggccaaaacagatctggaaaaaacaaagtccaagcaactggattatccatcttgttgtgtggttctgtctgcactggcataagcacatttcacaaggcacttttgcagccaggcattggggctgcataaatggttttttaaaaatcctttcccaaaaggcaaagctgggttgctgggattcttgggaaatgtaatagaatgggaattcagaatgcggtttactgcagaatttacagcatggcaataaaggctctctatgttcagggggtgagagaagagactagatgcattgtctcagatgtctcctgacttcctgagaaatgccactttgcagatatggggctgcttttcacactggctaagtcagttcatggcaaaatatgagggaattcagtgtgtttcagacactaaccaaagtccatccttcctttctccttccgtccctcccttcctccctttctcactcactctctctttctttttaatgccatggagtaccatatttttcaaagttccaacaaagatgcactacatttagacaatgtggaaatggccctcagccttctctccctgaagtctgtggccagcaaaaatctggactttacttcactctgatgctgaacacccccctcccccacctcttccccaatatctcagatcccaagcctccctggtttgcttctaggaaagctcagcaattccctgaaaagaatgcagctcaagtgactgctccactttttcaccttggcctttgcggaaggctgtggctgggctaccctatgcatcgatcaatgaggtcatatttacccagtgcttggcctagaggcccaagacagggtcagcagtgcttgctttggctctagtttgggcgttggttttgcagcctcagcatcagcacaggcaggccctcttctccagcagtgctctggctgatatttcttctttttcccacagccaatcccactaatcctgatgaggctgacaaagttggggtgagtgatcccagccatctccccctcccttctcccctgttgccttttctgttgccttctttcctaggccctctctgtggatccttactgctggtttctgccttctctaggctgagaacacaatcacctattcacttctcatgcacccggatgctctggaagagcctgatgaccagaaccgtatttagtctccattgtcttgcattgggatttgagaagaaaatcagagagggaagatctggtatttcctggcctaaattccccttggggaggacagggagatgctgcagttccaaaagagaaggtttcttccagagtcatctacctgagtcctgaagctccctgtcctgaaagccacagacaatatggtcccaaataaccgactgcaccttctgtgcttcagctcttcttgacatcaaggctcttccgttccacatccacacagccaatccaattaatcaaaccactgttattaacagataatagcaacttgggaaatgcttatgttacaggttacgtgagaacaatcatgtaaatctatatgatttcagaaatgttaaaatagactaacctctaccagcacattaaaagtgattgtttctgggtgataaaattattgatgatttttattttctttatttttctataaagatcatatattacttttataataaaacattataaaaacaacattctgtttaccttttcaaggctgtattggttggagtgtagactgaactgcctggggtctgtttctcttcagtgatgagactcttaggaaggcaggaatggataggatagggggaggagaggagagatggggatttagaatgtagagtgagtgccccttttcttaaaactgaatacagtcacgcaccacataatgatgtttagttcaacaacagactgcatatatgatggtgatcccataaaattataataccatatttctattgtaccttttctattcctatgtttagatatatgagtacttaccattgtgttacaattgcctaaagtattcagtacagtagcatgctgtacaggtttgtagcctaggggcaataggctatacgctacagcctaggtgtgtagtaggccacaccatttaggtttgtataagtacctgctatgatgttcacacaacaaaattgcctgcatttctcaaaatgtatccccatatttcaacaatgcatgactgtactcttctgccaatgaccttgtattcttgtttccatgtcttcttctctttcctcctatggcaaataaaacactgttttgcaacacaa

SEQ ID NO: 40 - protein, 10 aa, Artificial Sequence
  immunogenic peptide
CQGARSPESD

SEQ ID NO: 41 - protein, 17 aa, Artificial Sequence
  immunogenic peptide
AKEGELSLPQHQSGEHP

SEQ ID NO: 42 - DNA, 333 bp, Artificial Sequence
  VH chain
gaggtgaagctgcaggagtcaggacctagcctggtgcagccaggaggatccatgaatctgtcctgtgtggcctccggctttaccttctccacccactggatgagctgggtgaggcagagccccgagaagggcctggagtggatcgccgagatcagactgaagaccgataactacgccacacactacgccgagagcgtgaagggcctgtttacaatctccagggatgactccaagtccagactgtacctgcagatgaagtccctgagaacagaggatagcggcatctactactgtacaacccacttcgcctactggggccagggcacactggtg

SEQ ID NO: 43 - protein, 111 aa, Artificial Sequence
  VH sequence
EVKLQESGPSLVQPGGSMNLSCVASGFTFSTHWMSWVRQSPEKGLEWIAEIRLKTDNYATHYAESVKGLFTISRDDSKSRLYLQMKSLRTEDSGIYYCTTHFAYWGQGTLV

SEQ ID NO: 44 - protein, 8 aa, Artificial Sequence
  VH CDR1
GFTFSTHW

SEQ ID NO: 45 - protein, 10 aa, Artificial Sequence
  VH CDR2
IRLKTDNYAT

SEQ ID NO: 46 - protein, 6 aa, Artificial Sequence
  VH CDR3
TTHFAY

SEQ ID NO: 47 - DNA, 339 bp, Artificial Sequence
  VL sequence
gatgttgtgatggcccaaagtccactctccctgcctgtcagtcttggagatcaagcctccatctcttgcagatctagtcagagccttgtggacagtcatggaaacacctatttacattggtacctgcagaagccgggccagtctccaaagctcctgatctacaaagttgccaaccgattttctggggtcccagacaggttcagtggcagtggatcagggacagatttcacactcaagatcagcagagtggaggctgaggatctgggagtttatttctgctctcaaagtacacatgttcctccggtcacgttcggtgctgggaccaagctggagctgaaa

SEQ ID NO: 48 - protein, 113 aa, Artificial Sequence
  VL sequence
DVVMAQSPLSLPVSLGDQASISCRSSQSLVDSHGNTYLHWYLQKPGQSPKLLIYKVANRFSGVPDRFSGSGSGTDFTLKISRVEAEDLGVYFCSQSTHVPPVTFGAGTKLELK

SEQ ID NO: 49 - protein, 11 aa, Artificial Sequence
  VL CDR1
QSLVDSHGNTY

SEQ ID NO: 50 - protein, 10 aa, Artificial Sequence
  VL CDR3
SQSTHVPPVT

The invention claimed is:

1. An anti-CD32a antibody that does not recognize a CD32b marker, wherein the anti-CD32a antibody is a murine antibody comprising for the heavy chain, complementarity determining region (CDR) sequences as set forth in SEQ ID NOs: 44-46, and for the light chain, CDR sequences as set forth in SEQ ID NO: 49, KVA and SEQ ID NO: 50.

2. The anti-CD32a antibody according to claim 1, wherein the antibody comprises a variable region of its heavy chain comprising the amino acid sequence as set forth in SEQ ID NO: 43 and a variable region of its light chain having the amino acid sequence as set forth in SEQ ID NO: 47.

3. The anti-CD32a antibody according to claim 1, wherein the antibody is a chimeric or humanized antibody.

4. The anti-CD32a antibody according to claim 1, wherein the antibody is a bispecific antibody further comprising a heavy and a light chain comprising CDRs recognizing a CD3 antigen.

* * * * *